(12) United States Patent
Watts et al.

(10) Patent No.: US 11,926,834 B2
(45) Date of Patent: Mar. 12, 2024

(54) COMPOSITIONS AND METHODS FOR RNA-ENCODED DNA-REPLACEMENT OF ALLELES

(71) Applicant: Pairwise Plants Services, Inc., Durham, NC (US)

(72) Inventors: Joseph Matthew Watts, Cary, NC (US); Aaron Hummel, Hillsborough, NC (US); Yongjoo Kim, Durham, NC (US); Shai Joshua Lawit, Durham, NC (US); David Schwark, Apex, NC (US)

(73) Assignee: Pairwise Plants Services, Inc., Durham, NC (US)

( * ) Notice: Subject to any disclaimer, the term of this patent is extended or adjusted under 35 U.S.C. 154(b) by 186 days.

(21) Appl. No.: 17/090,334

(22) Filed: Nov. 5, 2020

(65) Prior Publication Data

US 2021/0130835 A1 May 6, 2021

Related U.S. Application Data

(60) Provisional application No. 62/930,836, filed on Nov. 5, 2019.

(51) Int. Cl.
*C12N 15/82* (2006.01)
*C12N 9/22* (2006.01)
*C12N 15/11* (2006.01)
*C12N 15/113* (2010.01)

(52) U.S. Cl.
CPC ............. *C12N 15/82* (2013.01); *C12N 9/22* (2013.01); *C12N 15/113* (2013.01); *C12N 2310/20* (2017.05)

(58) Field of Classification Search
CPC ........ C12N 15/82; C12N 9/22; C12N 15/113; C12N 2310/20
See application file for complete search history.

(56) References Cited

U.S. PATENT DOCUMENTS

| | | | |
|---|---|---|---|
| 5,459,252 A | 10/1995 | Conkling et al. | |
| 5,604,121 A | 2/1997 | Hilder et al. | |
| 5,625,136 A | 4/1997 | Koziel et al. | |
| 5,641,876 A | 6/1997 | McElroy et al. | |
| 6,040,504 A | 3/2000 | Rice et al. | |
| 7,141,424 B2 | 11/2006 | Shin et al. | |
| 7,166,770 B2 | 1/2007 | Hohn et al. | |
| 7,579,516 B2 | 8/2009 | Boudreau | |
| 9,790,490 B2 | 10/2017 | Zhang et al. | |
| 9,982,053 B2 | 5/2018 | Pantaleo et al. | |
| 10,421,972 B2 | 9/2019 | Lira et al. | |
| 11,293,019 B2* | 4/2022 | Park | C12N 15/102 |
| 11,447,770 B1* | 9/2022 | Liu | C12N 15/907 |
| 2014/0123341 A1 | 5/2014 | Azhakanandam | |
| 2017/0219596 A1 | 8/2017 | Tanenbaum et al. | |
| 2017/0247671 A1 | 8/2017 | Yung et al. | |
| 2018/0155716 A1 | 6/2018 | Zhang et al. | |
| 2018/0170985 A1 | 6/2018 | Tremblay et al. | |
| 2018/0298392 A1* | 10/2018 | Cotta-Ramusino | C12N 15/102 |
| 2018/0327785 A1 | 11/2018 | Cigan et al. | |
| 2019/0010441 A1 | 1/2019 | Kindaichi | |
| 2019/0010481 A1 | 1/2019 | Joung et al. | |
| 2019/0100775 A1 | 4/2019 | Donohoue et al. | |
| 2019/0136249 A1 | 5/2019 | Sakai et al. | |
| 2019/0161760 A1 | 5/2019 | Hummel | |
| 2019/0203216 A1 | 7/2019 | Jacobsen et al. | |
| 2019/0218547 A1 | 7/2019 | Lee et al. | |
| 2019/0256900 A1 | 8/2019 | Zhang et al. | |
| 2021/0147862 A1 | 5/2021 | Hummel et al. | |
| 2022/0145334 A1 | 5/2022 | Kim et al. | |

FOREIGN PATENT DOCUMENTS

| | | | |
|---|---|---|---|
| EP | 0255378 A2 | 2/1988 | |
| EP | 0342926 A2 | 11/1989 | |
| EP | 0452269 A2 | 10/1991 | |
| WO | 9307278 A1 | 4/1993 | |
| WO | 9942587 A1 | 8/1999 | |
| WO | 0173087 A1 | 10/2001 | |
| WO | 2015026886 A1 | 2/2015 | |
| WO | 2017189308 A1 | 11/2017 | |
| WO | 2018022634 A1 | 2/2018 | |
| WO | 2018049168 A1 | 3/2018 | |
| WO | 2018136783 A1 | 7/2018 | |
| WO | 2018202199 A1 | 11/2018 | |
| WO | 2020191153 A2 | 9/2020 | |
| WO | 2020191234 A1 | 9/2020 | |
| WO | 2020191241 A1 | 9/2020 | |
| WO | 2020191249 A1 | 9/2020 | |
| WO | WO 2020/191243 A1 | 9/2020 | |
| WO | WO-2020191171 A9 * | 10/2020 | |
| WO | 2021092130 A1 | 5/2021 | |

OTHER PUBLICATIONS

Epstein et al., "Engineering a Self-Inactivating CRISPR System for AAV Vectors," Mol. Ther., 24 (2016): S50 (Year: 2016).*
Rocha, et al. (2004). Design of specie-specific primers for virus diagnosis in plants with pcr. In Proceedings. Fourth IEEE Symposium on Bioinformatics and Bioengineering (pp. 149-155). IEEE (Year: 2004).*
Li et al. (Published Mar. 12, 2018). CRISPR-Cas12a has both cis-and trans-cleavage activities on single-stranded DNA. Cell research, 28(4), 491-493. (Year: 2018).*
Zhong et al. (2017). Cpf1 proteins excise CRISPR RNAs from mRNA transcripts in mammalian cells. Nature chemical biology, 13(8), 839-841. (Year: 2017).*
Li et al. (Published Mar. 12, 2018). CRISPR-Cas12a has both cis- and trans-cleavage activities on single-stranded DNA. Cell research, 28(4), 491-493. Supplementary Information. (Year: 2018).*

(Continued)

*Primary Examiner* — Brent T Page
*Assistant Examiner* — Santosh Sharma
(74) *Attorney, Agent, or Firm* — Myers Bigel, P.A.

(57) ABSTRACT

This invention relates to recombinant nucleic constructs comprising Type V CRISPR-Cas effector proteins, reverse transcriptases and extended guide nucleic acids and methods of use thereof for modifying nucleic acids in plants.

15 Claims, 13 Drawing Sheets

Specification includes a Sequence Listing.

(56) References Cited

OTHER PUBLICATIONS

Zhong et al. (2017). Cpf1 proteins excise CRISPR RNAs from mRNA transcripts in mammalian cells. Nature chemical biology, 13(8), 839-841, Supplementary Information. (Year: 2017).*
Anzalone et al. "Search- and-replace genome editing without double-strand breaks or donor DNA" Nature, 576:149-175 2019.
International Search Report and Written Opinion corresponding to International Application No. PCTUS2020059045, dated Feb. 9, 2021, 16 pages.
Levin et al. "Dynamic interactions between transposable elements and their hosts" Nat. Rev Genet, 12:1-31 2011.
Sundararaman et al. "Resources for the Comprehensive Discovery of Functional RNA Elements" Mol Cell, 61:903-913 2016.
Gaudelli, Nicole M., et al., "Programmable base editing of A•T to G•C in genomic DNA without DNA cleavage", Nature. 551(7681): 464-471 (2017).
Balakrishnan et al. "Flap Endonuclease 1" Annual Review of Biochemistry, 82:119-138 (2013).
Barrangou, Rodolphe "Diversity of CRISPR-Cas immune systems and molecular machines" Genome Biology, 16(247):1-11 (2015).
Briner et al. "Lactobacillus buchneri Genotyping on the Basis of Clustered Regularly Interspaced Short Palindromic Repeat (CRISPR) Locus Diversity" Applied and Environmental Microbiology, 80(3):994-1001 (2014).
Gilbreth et al. "Structural Insights for Engineering Binding Proteins Based on Non-Antibody Scaffolds" Current Opinion in Structural Biology, 22(4):413-420 (2012).
Grissa et al. "CRISPRFinder: a web tool to identify clustered regularly interspaced short palindromic repeats" Nucleic Acids Research, 35:W52-W57 (2007).
International Search Report and the Written Opinion of the International Searching Authority corresponding to International Patent Application No. PCT/US2020/057121 (21 pages) (dated Feb. 8, 2021).
International Search Report and the Written Opinion of the International Searching Authority corresponding to International Patent Application No. PCT/US2020/058082 (16 pages) (dated Feb. 8, 2021).
International Search Report and the Written Opinion of the International Searching Authority corresponding to International Patent Application No. PCT/US2021/058235 (28 pages) (dated May 3, 2022).
Jankowsky et al. "Specificity and non-specificity in RNA-protein interactions" Nature Reviews Molecular Cell Biology, 16(9):533-544 (2015).
Jiang et al. "CRISPR-assisted editing of bacterial genomes" Nature Biotechnology, 31(3):233-239 (2013).
Mali et al. "Cas9 as a versatile tool for engineering biology" Nature Methods, 10(10):957-963 (2013).
Mali et al. "RNA-Guided Human Genome Engineering via Cas9" Science, 339(6121):823-826 (2013).
Mohr et al. "A Reverse Transcriptase-Cas1 Fusion Protein Contains a Cas6 Domain Required for Both CRISPR RNA Biogenesis and RNA Spacer Acquisition" Molecular Cell, 72(4):700-714 (2018).
Ran et al. "Genome engineering using the CRISPR-Cas9 system" Nature Protocols, 8(11):2281-2308 (2013).
Sha et al. "Monobodies and other synthetic binding proteins for expanding protein science" Protein Science, 26:910-924 (2017).
Tak et al. "Inducible and multiplex gene regulation using CRISPR-Cpf1-based transcription factors" Nature Methods, 14(12):1163-1166 (2017).
Tanenbaum et al. "A protein tagging system for signal amplification in gene expression and fluorescence imaging" Cell 159, 635-646 (2014).
Vob et al. "Chemically induced dimerization: reversible and spatiotemporal control of protein function in cells" Current Opinion in Chemical Biology, 28:194-201 (2015).

Yamano, Takashi, et al., "Structural Basis for the Canonical and Non-canonical PAM Recognition by CRISPR-Cpf1", Mol Cell 67(4), 2017, 633-645.e3.
Baba, Misato, et al., "Further increase in thermostability of Moloney murine leukemia virus reverse transcriptase by mutational combination", Protein Engineering, Design & Selection, vol. 30, No. 8, pp. 551-557 (2017).
Bandyopadhyay, Anindya, et al., "CRISPR-Cas12a (Cpf1): A Versatile Tool in the Plant Genome Editing Tool Box for Agricultural Advancement", Frontiers in Plant Science, vol. 11, Article 584151 (2020) (17 pages).
Jiang, Yuan-Yuan, et al., "Prime editing efficiently generates W542L and S621I double mutations in two ALS genes in maize", Genome Biology, 21:257 (2020) (10 pages).
Lin, Qiupeng, et al., "Prime genome editing in rice and wheat", Nature Biotechnology, vol. 38, pp. 582-585 (2020).
Ming, Meiling, et al., "CRISPR-Cas12b enables efficient plant genome engineering", Nature Plants, vol. 6, No. 3, pp. 202-208 (2020).
Xu, Rongfang, et al., "Development of Plant Prime-Editing Systems for Precise Genome Editing", Plant Communications 1, 100043 (2020) (8 pages).
U.S. Appl. No. 17/300,668, filed Mar. 19, 2020, Liu et al.
U.S. Appl. No. 17/219,590, filed Mar. 31, 2021, Liu et al.
U.S. Appl. No. 17/219,635, filed Mar. 31, 2021, Liu et al.
U.S. Appl. No. 17/440,682, filed Sep. 17, 2021, Liu et al.
U.S. Appl. No. 17/751,599, filed May 23, 2022, Liu et al.
"New Kid on the Block: Prime Editing as a Precision Gene Editing Tool", A Comprehensive Guide on CRISPR Methods, Chapter 4. Retrieved from: https://www.synthego.com/guide/crispr-methods/prime-editing on Dec. 17, 2022, 3 pages.
"Science", Prime Medicine. Retrieved from: https://primemedicine.com/science/ on Dec. 17, 2022, 16 pages.
Kim, Hui Kwon, et al., "Predicting the efficiency of prime editing guide RNAs in human cells", Nature Biotechnology. 39: 198-206 (2021).
Extended European Search Report corresponding to European Patent Application No. 20879965.0 (7 pages) (dated Nov. 8, 2023).
"New Kid on the Block: Prime Editing as a Precision Gene Editing Tool", A Comprehensive Guide on CRISPR Methods, Chapter 4. Retrieved from: https://www.synthego.com/guide/crispr-methods/prime-editing on Sep. 14, 2023, 7 pages.
Adikusuma, Fatwa, et al., "Optimized nickase- and nuclease-based prime editing in human and mouse cells", Nucleic Acids Research, 49(18):10785-10795, 2021.
Anzalone, Andrew V., et al., "Programmable large DNA deletion, replacement, integration, and inversion with twin prime editing and site-specific recombinases", bioRxiv. doi: https://doi.org/10.1101/2021.11.01.466790, 2021.
Anzalone, Andrew V., et al., "Supplementary Information for Search-and-replace genome editing without double-strand breaks or donor DNA", Nature 576, 2019.
Cofsky, Joshua C., et al., "CRISPR-Cas12a exploits R-loop asymmetry to form double-strand breaks", eLife. 9:e55143, 2020.
Jiang, Fuguo, et al., "Structures of a CRISPR-Cas9 R-loop complex primed for DNA cleavage", Science. 351(6275): 867-871, 2016.
Kim, Y. Bill, et al., "A novel mechanistic framework for precise sequence replacement using reverse transcriptase and diverse CRISPR-Cas systems", bioRxiv, doi: https://doi.org/10.1101/2022.12.13.520319, 2022.
Nelson, James W., et al., "Engineered pegRNAs improve prime editing efficiency", Nat Biotechnol. 40(3): 402-410, 2022.
Orlova, Marianna, et al., "Reverse transcriptase of Moloney murine leukemia virus binds to eukaryotic release factor 1 to modulate suppression of translational termination", Cell, 115(3): 319-331, 2003.
Yan, Winston X., et al., "Functionally diverse type V CRISPR-Cas systems", Science 363: 88-91, 2019.
Extended European Search Report corresponding to EP 20884787.1, dated Nov. 23, 2023 (8 pages).

* cited by examiner

US 11,926,834 B2

COMPOSITIONS AND METHODS FOR RNA-ENCODED DNA-REPLACEMENT OF ALLELES

STATEMENT REGARDING ELECTRONIC FILING OF A SEQUENCE LISTING

A Sequence Listing in ASCII text format, submitted under 37 C.F.R. § 1.821, entitled 1499-12_ST25.txt, 768691 bytes in size, generated on Nov. 5, 2020 and filed via EFS-Web, is provided in lieu of a paper copy. This Sequence Listing is hereby incorporated herein by reference into the specification for its disclosures.

PRIORITY STATEMENT

This application claims the benefit, under 35 U.S.C. § 119 (e), of U.S. Provisional Application No. 62/930,836 filed on Nov. 5, 2019, the entire contents of which is incorporated by reference herein.

FIELD OF THE INVENTION

This invention relates to recombinant nucleic constructs comprising Type V CRISPR-Cas effector proteins, reverse transcriptases and extended guide nucleic acids and methods of use thereof for modifying nucleic acids in plants.

BACKGROUND OF THE INVENTION

Base editing has been shown to be an efficient way to change cytosine and adenine residues to thymine and guanine, respectively. These tools, while powerful, do have some limitations such as bystander bases, small base editing windows that give limited accessibility to trait-relevant targets unless enzymes with high PAM density are available to compensate, limited ability to convert cytosines and adenines to residues other than thymine and guanine, respectively, and no ability to edit thymine or guanine residues. Thus, the current tools available for base editing are limited. Therefore, to make nucleic acid editing more useful by increasing the range of possible edits for a greater number of organisms, new editing tools are needed.

SUMMARY OF THE INVENTION

In a first aspect, a method of modifying a target nucleic acid is provided, the method comprising: contacting the target nucleic acid with (a) a Type V CRISPR-Cas effector protein or a Type II CRISPR-Cas effector protein; (b) a reverse transcriptase, and (c) an extended guide nucleic acid (e.g., extended Type II or Type V CRISPR RNA, extended Type II or Type V CRISPR DNA, extended Type II or Type V crRNA, extended Type II or Type V crDNA), thereby modifying the target nucleic acid.

In a second aspect, a method of modifying a target nucleic acid is provided, the method comprising: contacting the target nucleic acid at a first site with (a)(i) a first CRISPR-Cas effector protein; and (ii) a first extended guide nucleic acid (e.g., extended CRISPR RNA, extended CRISPR DNA, extended crRNA, extended crDNA); and (b)(i) a second CRISPR-Cas effector protein, (ii) a first reverse transcriptase; and (ii) a first guide nucleic acid, thereby modifying the target nucleic acid.

In a third aspect, a method of modifying a target nucleic acid in a plant or plant cell is provided, comprising introducing the expression cassette of the invention into the plant or plant cell, thereby modifying the target nucleic acid in the plant or plant cell and producing a plant or plant cell comprising the modified target nucleic acid.

In a fourth aspect, a complex is provided comprising: (a) a Type V CRISPR-Cas effector protein or a Type II CRISPR-Cas effector protein; (b) a reverse transcriptase, and (c) an extended guide nucleic acid (e.g., extended CRISPR RNA, extended CRISPR DNA, extended crRNA, extended crDNA; e.g., targeted allele guide (tag) nucleic acid (i.e., tagDNA, tagRNA)).

In a fifth aspect, an expression cassette codon optimized for expression in an organism is provided, the expression cassette comprising 5' to 3' (a) polynucleotide encoding a plant specific promoter sequence (e.g. ZmUbi1, MtUb2, RNA polymerase II (Pol II)), (b) a plant codon-optimized polynucleotide encoding a Type V CRISPR-Cas nuclease (e.g., Cpf1 (Cas12a), dCas12a and the like); (c) a linker sequence; and (d) a plant codon-optimized polynucleotide encoding a reverse transcriptase.

In a sixth aspect, an expression cassette codon optimized for expression in an organism is provided, the expression cassette comprising: (a) a polynucleotide encoding a promoter sequence, and (b) an extended RNA guide sequence, wherein the extended guide nucleic acid comprises an extended portion comprising at its 3' end a primer binding site and an edit to be incorporated into the target nucleic acid (e.g., reverse transcriptase template), optionally wherein the extended guide nucleic acid is comprised in an expression cassette, optionally wherein the extended guide nucleic acid is operably linked to a Pol II promoter.

The invention further provides cells, including plant cells, bacterial cells, archaea cells, fungal cells, animal cells comprising target nucleic acids modified by the methods of the invention as well as organisms, including plants, bacteria, archaea, fungi, and animals, comprising the cells. Additionally, the present invention provides kits comprising the polynucleotides, polypeptides, and expression cassettes of the invention.

These and other aspects of the invention are set forth in more detail in the description of the invention below.

BRIEF DESCRIPTION OF THE SEQUENCES

SEQ ID NOs:1-17 are example Cas12a amino acid sequences useful with this invention.

SEQ ID NOs:18-20 are example Cas12a nucleotide sequences useful with this invention.

SEQ ID NO:21 and SEQ ID NO:22 are exemplary regulatory sequences encoding a promoter and intron.

SEQ ID NOs:23-25 provide example peptide tags and affinity polypeptides.

SEQ ID NO:26-36 provide example RNA recruiting motifs and corresponding affinity polypeptides.

SEQ ID NOS:37-52 provide example single stranded RNA binding domains (RBDs) SEQ ID NO:53 and SEQ ID NO:97 provide example reverse transcriptase sequences (M-MuLV).

SEQ ID NOs:54-56 provides an example of a protospacer adjacent motif position for a Type V CRISPR-Cas12a nuclease.

SEQ ID NO:57 and SEQ ID NO:58 provide example constructs of the invention.

SEQ ID NO:59 and SEQ ID NO:60 provide an example CRISPR RNA and an example protospacer.

SEQ ID NO:61 and SEQ ID NO:62 provide example introns.

SEQ ID NOs:63-86 provide example REDRAW editor constructs.

SEQ ID NO:87 provides an example of a tagRNA having an 11 base pair (bp) primer binding sequence and a 96 bp reverse transcriptase template.

SEQ ID NOs:88-91 provide sequences of example plasmids.

Figure 9:
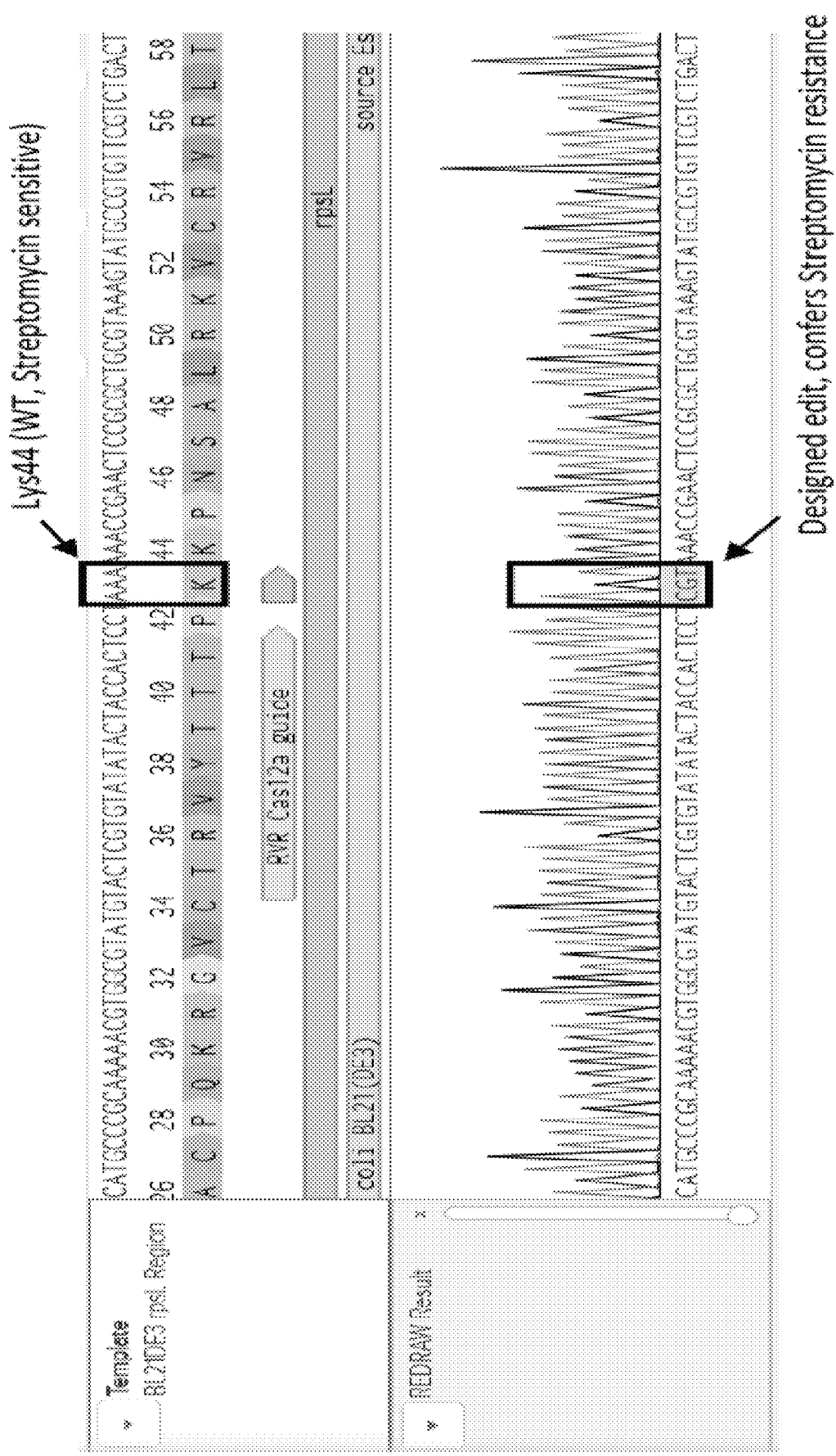
FIG. 9 shows Sanger sequencing results demonstrating an AAA>CGT edit in the rpsL gene in the E. coli genome, conferring resistance to the antibiotic streptomycin. The edit was observed from a colony in Selection 2.5, with protein configuration SV40-MMLV-RT-XTEN-nRVRLbCas12a (H759A)-SV40 (SEQ ID NO:79).
Figure 10:
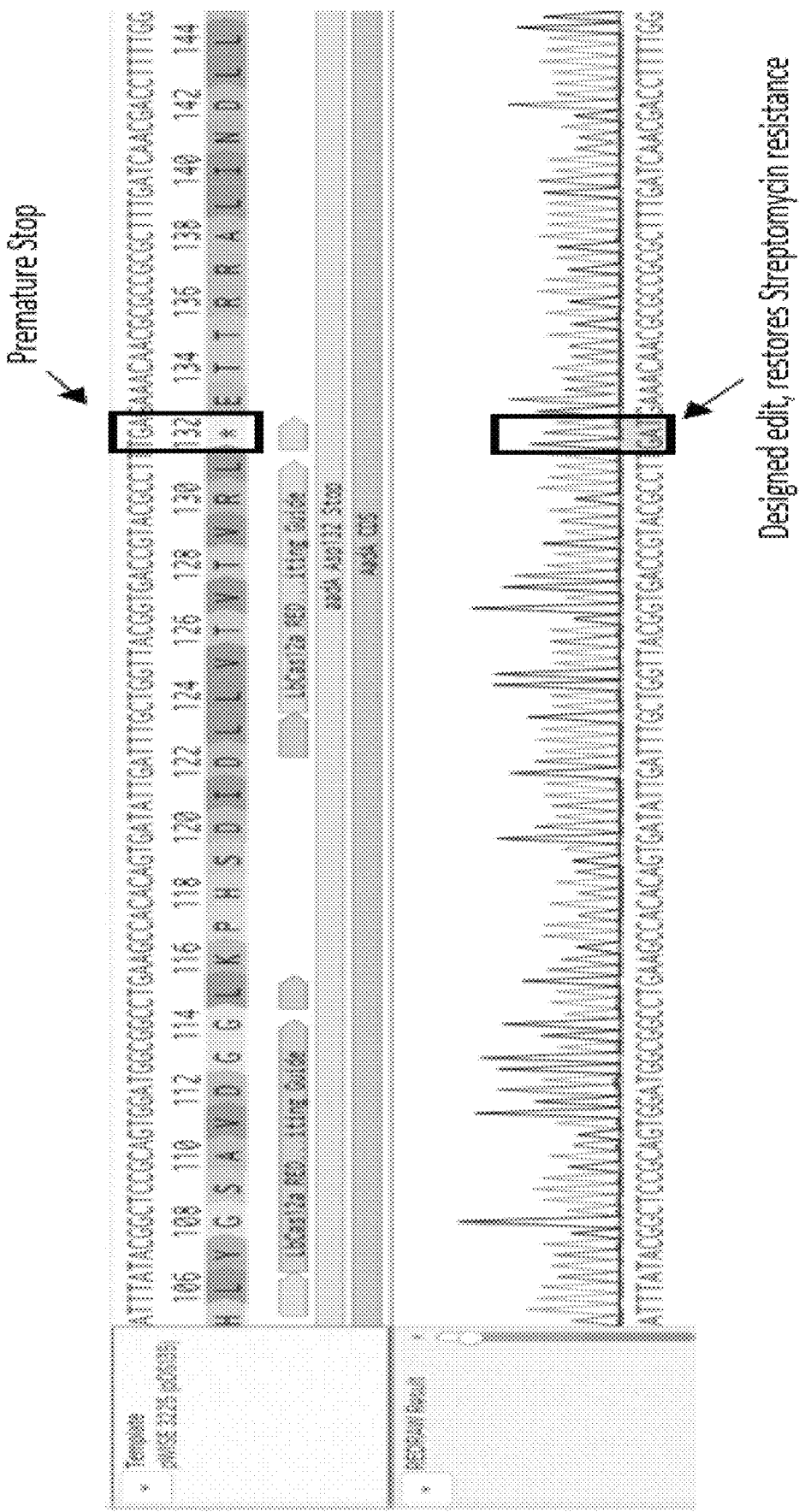
FIG. 10 shows Sanger sequencing results demonstrating a TGA>GAT edit in a defunct aadA gene, restoring antibiotic resistance. The edit was observed from a colony in Selection 2.25, with protein configuration SV40-nLbCas12a-XTEN-MMLV-RT-SV40 (SEQ ID NO:73).
Figure 11:
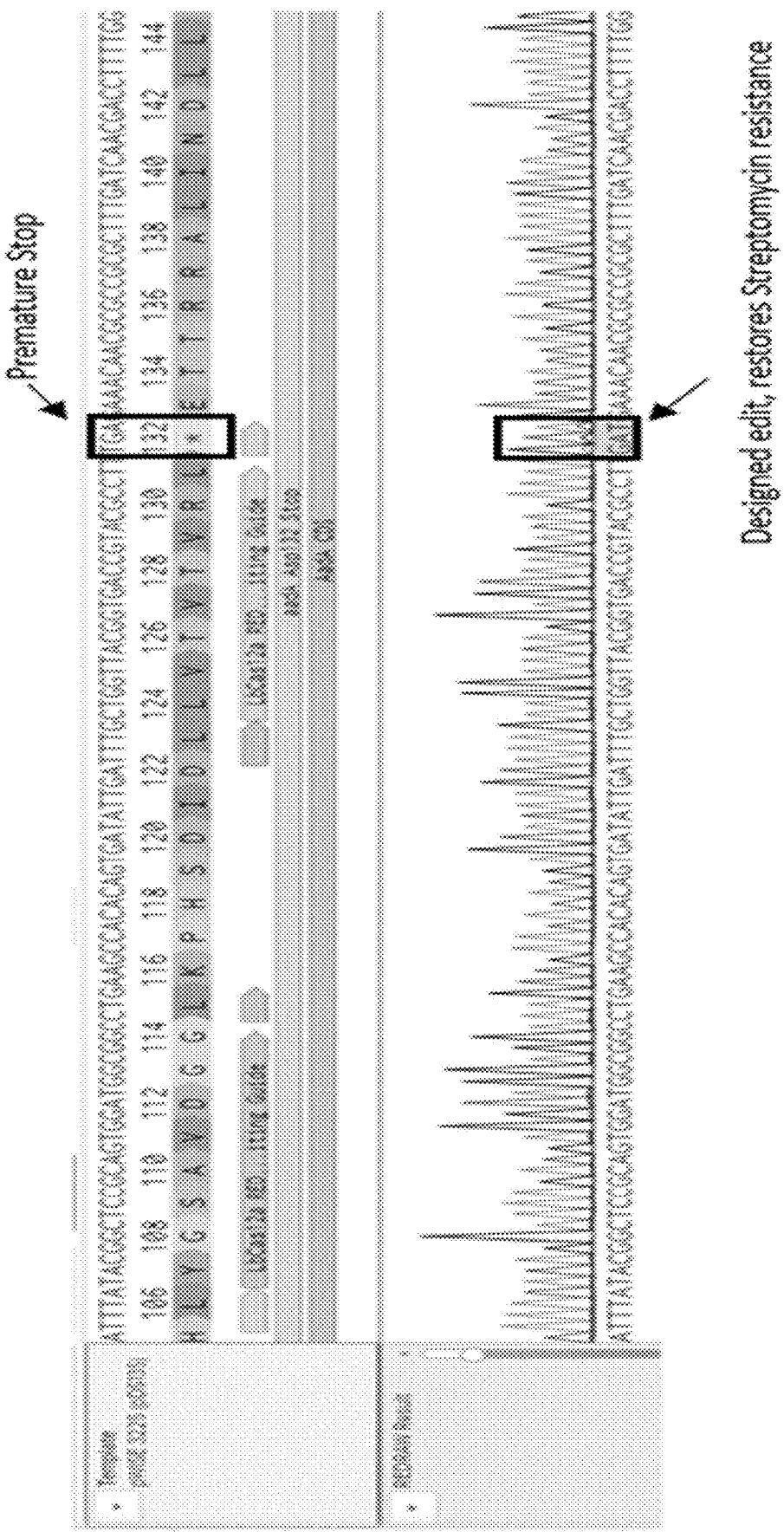
FIG. 11 shows Sanger sequencing results demonstrating a TGA>GAT edit in a defunct aadA gene, restoring antibiotic resistance. The edit was observed from a colony in Selection 2.31, with protein configuration SV40-MMLV-RT-XTEN-nLbCas12a(H759A)-SV40 (SEQ ID NO:83).

SEQ ID NOs:92-94 provide sequences of tagRNAs associated with the edits shown in FIGS. 9-11, respectively.

SEQ ID NO:96 provides an example LbCas12a having a mutation of H759A and flanked with NLS on both sides.

SEQ ID NOs:98-101 provide example 5'-3' exonuclease polypeptides.

SEQ ID NO:102 and SEQ ID NO:103 provide example DMNT1 target site and target spacer.

SEQ ID NO:104 and SEQ ID NO:105 provide example FANCF1 target site and target spacer.

DETAILED DESCRIPTION

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, 1%, ±0.5%, or even ±0.1% of the specified value as well as the specified value. For example, "about X" where X is the measurable value, is meant to include X as well as variations of ±10%, ±5%, ±1%, ±0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

Recitation of ranges of values herein are merely intended to serve as a shorthand method of referring individually to each separate value falling within the range, unless otherwise indicated herein, and each separate value is incorporated into the specification as if it were individually recited herein. For example, if the range 10 to 15 is disclosed, then 11, 12, 13, and 14 are also disclosed.

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "enhance," "enhancing," "improve" and "improving" (and grammatical variations thereof) describe an elevation of at least about 25%, 50%, 75%, 100%, 150%, 200%, 300%, 400%, 500% or more as compared to a control.

As used herein, the terms "reduce," "reduced," "reducing," "reduction," "diminish," and "decrease" (and grammatical variations thereof), describe, for example, a decrease of at least about 5%, 10%, 15%, 20%, 25%, 35%, 50%, 75%, 80%, 85%, 90%, 95%, 97%, 98%, 99%, or 100% as compared to a control. In particular embodiments, the reduction can result in no or essentially no (i.e., an insignificant amount, e.g., less than about 10% or even 5%) detectable activity or amount.

A "heterologous" or a "recombinant" nucleotide sequence is a nucleotide sequence not naturally associated with a host cell into which it is introduced, including non-naturally occurring multiple copies of a naturally occurring nucleotide sequence.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the reference organism. A "homologous" nucleic acid sequence is a nucleotide sequence naturally associated with a host cell into which it is introduced.

As used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "nucleic acid construct," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end of the polynucleotide. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end of the polynucleotide. Thus, for example, an element in the 3' region of a polynucleotide can be located anywhere from the first nucleotide located at the 3' end of the polynucleotide to the nucleotide located halfway through the polynucleotide.

As used herein, the term "gene" refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue.

The terms "complementary" or "complementarity," as used herein, refer to the natural binding of polynucleotides under permissive salt and temperature conditions by base-pairing. For example, the sequence "A-G-T" (5' to 3') binds to the complementary sequence "T-C-A" (3' to 5'). Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement" as used herein can mean 100% complementarity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

A "portion" or "fragment" of a nucleotide sequence of the invention will be understood to mean a nucleotide sequence of reduced length relative (e.g., reduced by 1, 2, 3, 4, 5, 6, 7, 8, 9, 10, 11, 12, 13, 14, 15, 16, 17, 18, 19, 20 or more nucleotides) to a reference nucleic acid or nucleotide sequence and comprising, consisting essentially of and/or consisting of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleic acid or nucleotide sequence. Such a nucleic acid fragment or portion according to the invention may be, where appropriate, included in a larger polynucleotide of which it is a constituent. As an example, a repeat sequence of a guide nucleic acid of this invention may comprise a portion of a wild type Type V CRISPR-Cas repeat sequence (e.g., a wild Type CRISPR-Cas repeat; e.g., a repeat from the CRISPR Cas system of a Cas12a (Cpf1), Cas12b (C2c1), Cas12c (C2c3), Cas12d (CasY), Cas12e (CasX), Cas12g, Cas12h, Cas12i, C2c4, C2c5, C2c8, C2c9, C2c10, Cas14a, Cas14b, and/or a Cas14c, and the like). In some embodiments, a repeat sequence of a guide nucleic acid of this invention may comprise a portion of a wild type CRISPR-Cas9 repeat sequence.

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to said nucleotide sequence of the invention.

As used herein "sequence identity" refers to the extent to which two optimally aligned polynucleotide or polypeptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence as compared to a reference polypeptide.

As used herein, the phrase "substantially identical," or "substantial identity" in the context of two nucleic acid molecules, nucleotide sequences or protein sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9% or more nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 20 nucleotides, about 10 nucleotides to about 25 nucleotides, about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, or more nucleotides in length, and any range therein, up to the full length of the sequence. In some embodiments, the nucleotide sequences can be substantially identical over at least about 20 nucleotides (e.g., about 20, 21, 22, 23, 24, 25, 26, 27, 28, 29, 30, 31, 32, 33, 34, 35, 36, 37, 38, 39, 40 nucleotides). In some embodiments, a substantially identical nucleotide or protein sequence performs substantially the same function as the nucleotide (or encoded protein sequence) to which it is substantially identical.

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, CA). An "identity fraction" for aligned segments of a test sequence and a reference sequence is the number of identical components which are shared by the two aligned sequences divided by the total number of components in the reference sequence segment, e.g., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Two nucleotide sequences may also be considered substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology-Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

The polynucleotide and/or recombinant nucleic acid constructs of this invention can be codon optimized for expression. In some embodiments, the polynucleotides, nucleic acid constructs, expression cassettes, and/or vectors of the invention (e.g., comprising/encoding a CRISPR-Cas effector protein (e.g., a Type V CRISPR-Cas effector protein), a reverse transcriptase, a flap endonuclease, a 5'-3' exonuclease, and the like) are codon optimized for expression in an organism (e.g., in a particular species), optionally an animal, a plant, a fungus, an archaeon, or a bacterium. In some embodiments, the codon optimized nucleic acid constructs, polynucleotides, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, or 99.9%) identity or more to the nucleic acid constructs, polynucleotides, expression cassettes, and/or vectors that have not been codon optimized.

In any of the embodiments described herein, a polynucleotide or nucleic acid construct of the invention may be operatively associated with a variety of promoters and/or other regulatory elements for expression in a plant and/or a cell of a plant. Thus, in some embodiments, a polynucleotide or nucleic acid construct of this invention may further comprise one or more promoters, introns, enhancers, and/or terminators operably linked to one or more nucleotide sequences. In some embodiments, a promoter may be operably associated with an intron (e.g., Ubi1 promoter and intron). In some embodiments, a promoter associated with an intron may be referred to as a "promoter region" (e.g., Ubi1 promoter and intron).

By "operably linked" or "operably associated" as used herein in reference to polynucleotides, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, nucleic acid sequences can be present between a promoter and the nucleotide sequence, and the promoter can still be considered "operably linked" to the nucleotide sequence.

As used herein, the term "linked," in reference to polypeptides, refers to the attachment of one polypeptide to another. A polypeptide may be linked to another polypeptide (at the N-terminus or the C-terminus) directly (e.g., via a peptide bond) or through a linker.

The term "linker" is art-recognized and refers to a chemical group, or a molecule linking two molecules or moieties, e.g., two domains of a fusion protein, such as, for example, a DNA binding polypeptide or domain and peptide tag and/or a reverse transcriptase and an affinity polypeptide that binds to the peptide tag; or a DNA endonuclease polypeptide or domain and peptide tag and/or a reverse transcriptase and an affinity polypeptide that binds to the peptide tag. A linker may be comprised of a single linking molecule or may comprise more than one linking molecule. In some embodiments, the linker can be an organic molecule, group, polymer, or chemical moiety such as a bivalent organic moiety. In some embodiments, the linker may be an amino acid or it may be a peptide. In some embodiments, the linker is a peptide.

In some embodiments, a peptide linker useful with this invention may be about 2 to about 100 or more amino acids in length, for example, about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 2 to about 40, about 2 to about 50, about 2 to about 60, about 4 to about 40, about 4 to about 50, about 4 to about 60, about 5 to about 40, about 5 to about 50, about 5 to about 60, about 9 to about 40, about 9 to about 50, about 9 to about 60, about 10 to about 40, about 10 to about 50, about 10 to about 60, or about 2, 3, 4, 5, 6, 7, 8, 9, 10, 11, 12, 13, 14, 15, 16, 17, 18, 19, 20, 21, 22, 23, 24, 25 amino acids to about 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 105, 110, 115, 120, 130, 140 150 or more amino acids in length). In some embodiments, a peptide linker may be a GS linker.

As used herein, the term "linked," or "fused" in reference to polynucleotides, refers to the attachment of one polynucleotide to another. In some embodiments, two or more polynucleotide molecules may be linked by a linker that can be an organic molecule, group, polymer, or chemical moiety such as a bivalent organic moiety. A polynucleotide may be linked or fused to another polynucleotide (at the 5' end or the 3' end) via a covalent or non-covenant linkage or binding, including e.g., Watson-Crick base-pairing, or through one or more linking nucleotides. In some embodiments, a polynucleotide motif of a certain structure may be inserted within another polynucleotide sequence (e.g. extension of the hairpin structure in guide RNA). In some embodiments, the linking nucleotides may be naturally occurring nucleotides. In some embodiments, the linking nucleotides may be non-naturally occurring nucleotides.

A "promoter" is a nucleotide sequence that controls or regulates the transcription of a nucleotide sequence (e.g., a coding sequence) that is operably associated with the promoter. The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. A promoter may comprise other elements that act as regulators of gene expression; e.g., a promoter region. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in Genetic Engineering of Plants, T. Kosuge, C. Meredith and A. Hollaender (eds.), Plenum Press, pp. 211-227). In some embodiments, a promoter region may comprise at least one intron (see, e.g., SEQ ID NO:21, SEQ ID NO:22).

Promoters useful with this invention can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a promoter functional in a plant may be used with the constructs of this invention. Non-limiting examples of a promoter useful for driving expression in a plant include the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. *Gene* 403:132-142 (2007); Li et al. *Mol Biol. Rep.* 37:1143-1154 (2010)). PrbcS1 and Pactin are constitutive promoters and Pnr and Pdca1 are inducible promoters. Pnr is induced by nitrate and repressed by ammonium (Li et al. *Gene* 403:132-142 (2007)) and Pdca1 is induced by salt (Li et al. *Mol Biol. Rep.* 37:1143-1154 (2010)). In some embodiments, a promoter useful with this invention is RNA polymerase II (Pol II) promoter. In some embodiments, a U6 promoter or a 7SL promoter from *Zea mays* may be useful with constructs of this invention. In some embodiments, the U6c promoter and/or 7SL promoter from *Zea mays* may be useful for driving expression of a guide nucleic acid. In some embodiments, a U6c promoter, U6i promoter and/or 7SL promoter from *Glycine max* may be useful with constructs of this invention. In some embodiments, the U6c promoter, U6i promoter and/or 7SL promoter from *Glycine max* may be useful for driving expression of a guide nucleic acid.

Examples of constitutive promoters useful for plants include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci USA* 84:5745-5749), Adh promoter (Walker et al. (1987) *Proc. Natl. Acad. Sci. USA* 84:6624-6629), sucrose synthase promoter (Yang & Russell (1990) *Proc. Natl. Acad. Sci. USA* 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and *Arabidopsis* (Norris et al. 1993. *Plant Molec. Biol.* 21:895-906). The maize ubiquitin promoter (UbiP) has been developed in transgenic monocot systems and its sequence and vectors constructed for monocot transformation are disclosed in the patent publication EP 0 342 926. The ubiquitin promoter is suitable for the expression of the nucleotide sequences of the invention in transgenic plants, especially monocotyledons. Further, the promoter expression cassettes described by McElroy et al. (*Mol. Gen. Genet.* 231: 150-160 (1991)) can be easily modified for the expression of the nucleotide sequences of the invention and are particularly suitable for use in monocotyledonous hosts.

In some embodiments, tissue specific/tissue preferred promoters can be used for expression of a heterologous polynucleotide in a plant cell. Tissue specific or preferred expression patterns include, but are not limited to, green tissue specific or preferred, root specific or preferred, stem specific or preferred, flower specific or preferred or pollen specific or preferred. Promoters suitable for expression in green tissue include many that regulate genes involved in photosynthesis and many of these have been cloned from both monocotyledons and dicotyledons. In one embodiment, a promoter useful with the invention is the maize PEPC promoter from the phosphoenol carboxylase gene (Hudspeth & Grula, *Plant Molec. Biol.* 12:579-589 (1989)). Non-limiting examples of tissue-specific promoters include those associated with genes encoding the seed storage proteins (such as 0-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) *Seed Sci. Res.* 1:209-219; as well as EP Patent No. 255378). Tissue-specific or tissue-preferential promoters useful for the expression of the nucleotide sequences of the invention in plants, particularly maize, include but are not limited to those that direct expression in root, pith, leaf or pollen. Such promoters are disclosed, for example, in WO 93/07278, herein incorporated by reference in its entirety. Other non-limiting examples of tissue specific or tissue preferred promoters useful with the invention the cotton rubisco promoter disclosed in U.S. Pat. No. 6,040,504; the rice sucrose synthase promoter disclosed in U.S. Pat. No. 5,604,121; the root specific promoter described by de Framond (*FEBS* 290:103-106 (1991); EP 0 452 269 to Ciba-Geigy); the stem specific promoter described in U.S. Pat. No. 5,625,136 (to Ciba-Geigy) and which drives expression of the maize trpA gene; the cestrum yellow leaf curling virus promoter disclosed in WO 01/73087; and pollen specific or preferred promoters including, but not limited to, ProOsLPS10 and ProOsLPS11 from rice (Nguyen et al. *Plant Biotechnol. Reports* 9(5):297-306 (2015)), ZmSTK2_USP from maize (Wang et al. *Genome* 60(6):485-495 (2017)), LAT52 and LAT59 from tomato (Twell et al. *Development* 109(3):705-713 (1990)), Zm13 (U.S. Pat. No. 10,421,972), PLA$_2$-δ promoter from *Arabidopsis* (U.S. Pat. No. 7,141,424), and/or the ZmC5 promoter from maize (International PCT Publication No. WO1999/042587.

Additional examples of plant tissue-specific/tissue preferred promoters include, but are not limited to, the root hair-specific cis-elements (RHEs) (Kim et al. *The Plant Cell* 18:2958-2970 (2006)), the root-specific promoters RCc3 (Jeong et al. *Plant Physiol.* 153:185-197 (2010)) and RB7 (U.S. Pat. No. 5,459,252), the lectin promoter (Lindstrom et al. (1990) *Der. Genet.* 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), S-adenosyl-L-methionine synthetase (SAMS) (Vander Mijnsbrugge et al. (1996) *Plant and Cell Physiology,* 37(8):1108-1115), corn light harvesting complex promoter (Bansal et al. (1992) *Proc. Natl. Acad. Sci. USA* 89:3654-3658), corn heat shock protein promoter (O'Dell et al. (1985) *EMBO J.* 5:451-458; and Rochester et al. (1986) *EMBO J.* 5:451-458), pea small subunit RuBP carboxylase promoter (Cashmore, "Nuclear genes encoding the small subunit of ribulose-1,5-bisphosphate carboxylase" pp. 29-39 In: *Genetic Engineering of Plants* (Hollaender ed., Plenum Press 1983; and Poulsen et al. (1986)*Mol. Gen. Genet.* 205:193-200), Ti plasmid mannopine synthase promoter (Langridge et al. (1989) *Proc. Natl. Acad. Sci. USA* 86:3219-3223), Ti plasmid nopaline synthase promoter (Langridge et al. (1989), supra), *petunia* chalcone isomerase promoter (van Tunen et al. (1988) *EMBO J.* 7:1257-1263), bean glycine rich protein 1 promoter (Keller et al. (1989) *Genes Dev.* 3:1639-1646), truncated CaMV 35S promoter (O'Dell et al. (1985) *Nature* 313:810-812), potato patatin promoter (Wenzler et al. (1989) *PlantMol. Biol.* 13:347-354), root cell promoter (Yamamoto et al. (1990) *Nucleic Acids Res.* 18:7449), maize zein promoter (Kriz et al. (1987) *Mol. Gen. Genet.* 207:90-98; Langridge et al. (1983) *Cell* 34:1015-1022; Reina et al. (1990) *Nucleic Acids Res.* 18:6425; Reina et al. (1990) *Nucleic Acids Res.* 18:7449; and Wandelt et al. (1989) *Nucleic Acids Res.* 17:2354), globulin-1 promoter (Belanger et al. (1991) *Genetics* 129:863-872), α-tubulin cab promoter (Sullivan et al. (1989)*Mol. Gen. Genet.* 215: 431-440), PEPCase promoter (Hudspeth & Grula (1989) *Plant Mol. Biol.* 12:579-589), R gene complex-associated promoters (Chandler et al. (1989) *Plant Cell* 1:1175-1183), and chalcone synthase promoters (Franken et al. (1991) *EMBO J.* 10:2605-2612).

Useful for seed-specific expression is the pea vicilin promoter (Czako et al. (1992) *Mol. Gen. Genet.* 235:33-40; as well as the seed-specific promoters disclosed in U.S. Pat. No. 5,625,136. Useful promoters for expression in mature leaves are those that are switched at the onset of senescence, such as the SAG promoter from *Arabidopsis* (Gan et al. (1995) *Science* 270:1986-1988).

In addition, promoters functional in chloroplasts can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

Additional regulatory elements useful with this invention include, but are not limited to, introns, enhancers, termination sequences and/or 5' and 3' untranslated regions.

An intron useful with this invention can be an intron identified in and isolated from a plant and then inserted into an expression cassette to be used in transformation of a plant. As would be understood by those of skill in the art, introns can comprise the sequences required for self-excision and are incorporated into nucleic acid constructs/expression cassettes in frame. An intron can be used either as a spacer to separate multiple protein-coding sequences in one nucleic acid construct, or an intron can be used inside one protein-coding sequence to, for example, stabilize the mRNA. If they are used within a protein-coding sequence, they are inserted "in-frame" with the excision sites included. Introns may also be associated with promoters to improve or modify expression. As an example, a promoter/intron combination useful with this invention includes but is not limited to that of the maize Ubi1 promoter and intron.

Non-limiting examples of introns useful with the present invention include introns from the ADHI gene (e.g., Adh1-Sintrons 1, 2 and 6), the ubiquitin gene (Ubi1), the RuBisCO small subunit (rbcS) gene, the RuBisCO large subunit (rbcL) gene, the actin gene (e.g., actin-1 intron), the pyruvate dehydrogenase kinase gene (pdk), the nitrate reductase gene (nr), the duplicated carbonic anhydrase gene 1 (Tdca1), the psbA gene, the atpA gene, or any combination thereof. Example intron sequences can include, but are not limited to, SEQ ID NO:61 and SEQ ID NO:62.

In some embodiments, a polynucleotide and/or a nucleic acid construct of the invention can be an "expression cassette" or can be comprised within an expression cassette. As used herein, "expression cassette" means a recombinant nucleic acid molecule comprising, for example, a nucleic acid construct of the invention (e.g., a CRISPR-Cas effector protein, a reverse transcriptase polypeptide or domain, a flap endonuclease polypeptide or domain (e.g., FEN)), and/or a 5'-3' exonuclease), wherein the nucleic acid construct is operably associated with at one or more control sequences (e.g., a promoter, terminator and the like). Thus, some embodiments of the invention provide expression cassettes designed to express, for example, a nucleic acid construct of the invention (e.g., a nucleic acid construct of the invention encoding a CRISPR-Cas effector protein or domain, a reverse transcriptase polypeptide or domain, a flap endonuclease polypeptide or domain and/or 5'-3' exonuclease polypeptide or domain. When an expression cassette of the present invention comprises more than one polynucleotide, the polynucleotides may be operably linked to a single promoter that drives expression of all of the polynucleotides or the polynucleotides may be operably linked to one or more separate promoters (e.g., three polynucleotides may be driven by one, two or three promoters in any combination). When two or more separate promoters are used, the promoters may be the same promoter or they may be different promoters. Thus, a polynucleotide encoding a CRISPR-Cas effector protein or domain, a polynucleotide encoding a reverse transcriptase polypeptide or domain, a polynucleotide encoding a flap endonuclease polypeptide or domain and/or a polynucleotide encoding a 5'-3' exonuclease polypeptide or domain comprised in an expression cassette may each be operably linked to a separate promoter or they may be operably linked to two or more promoters in any combination.

An expression cassette comprising a nucleic acid construct of the invention may be chimeric, meaning that at least one of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette can optionally include a transcriptional and/or translational termination region (i.e., termination region) and/or an enhancer region that is functional in the selected host cell. A variety of transcriptional terminators and enhancers are known in the art and are available for use in expression cassettes. Transcriptional terminators are responsible for the termination of transcription and correct mRNA polyadenylation. A termination region and/or the enhancer region may be native to the transcriptional initiation region, may be native, for example, to a gene encoding a CRISPR-Cas effector protein, a gene encoding a reverse transcriptase, a gene encoding a flap endonuclease, and/or a gene encoding a 5'-3' exonuclease, may be native to a host cell, or may be native to another source (e.g., foreign or heterologous to the promoter, to a gene encoding a CRISPR-Cas effector protein, a gene encoding a reverse transcriptase, a gene encoding a flap endonuclease, and/or a gene encoding a 5'-3' exonuclease, to the host cell, or any combination thereof).

An expression cassette of the invention also can include a polynucleotide encoding a selectable marker, which can be used to select a transformed host cell. As used herein, "selectable marker" means a polynucleotide sequence that when expressed imparts a distinct phenotype to the host cell expressing the marker and thus allows such transformed cells to be distinguished from those that do not have the marker. Such a polynucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

In addition to expression cassettes, the nucleic acid molecules/constructs and polynucleotide sequences described herein can be used in connection with vectors. The term "vector" refers to a composition for transferring, delivering or introducing a nucleic acid (or nucleic acids) into a cell. A vector comprises a nucleic acid construct comprising the nucleotide sequence(s) to be transferred, delivered or introduced. Vectors for use in transformation of host organisms are well known in the art. Non-limiting examples of general classes of vectors include viral vectors, plasmid vectors, phage vectors, phagemid vectors, cosmid vectors, fosmid vectors, bacteriophages, artificial chromosomes, minicircles, or *Agrobacterium* binary vectors in double or single stranded linear or circular form which may or may not be self transmissible or mobilizable. In some embodiments, a viral vector can include, but is not limited to a retroviral, lentiviral, adenoviral, adeno-associated, or herpes simplex viral vector. A vector as defined herein can transform a prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g., higher plant, mammalian, yeast or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter and/or other regulatory elements and in the case of cDNA this may be under the control of an appropriate promoter and/or other regulatory elements for expression in the host cell. Accordingly, a nucleic acid construct or polynucleotide of this invention and/or expression cassettes comprising the same may be comprised in vectors as described herein and as known in the art.

As used herein, "contact," "contacting," "contacted," and grammatical variations thereof, refer to placing the components of a desired reaction together under conditions suitable for carrying out the desired reaction (e.g., transformation, transcriptional control, genome editing, nicking, and/or cleavage). As an example, a target nucleic acid may be contacted with a Type II or Type V CRISPR-Cas effector protein, and a reverse transcriptase or a nucleic acid construct encoding the same, under conditions whereby the CRISPR-Cas effector protein and the reverse transcriptase are expressed and the CRISPR-Cas effector protein binds to the target nucleic acid, and the reverse transcriptase is either fused to the CRISPR-Cas effector protein or is recruited to the CRISPR-Cas effector protein (via, for example, a peptide tag fused to the CRISPR-Cas effector protein and an affinity tag fused to the reverse transcriptase) and thus, the reverse transcriptase is positioned in the vicinity of the target nucleic acid, thereby modifying the target nucleic acid. Other methods for recruiting a reverse transcriptase may be used that take advantage of other protein-protein interactions, and also RNA-protein interactions and chemical interactions.

As used herein, "modifying" or "modification" in reference to a target nucleic acid includes editing (e.g., mutating), covalent modification, exchanging/substituting nucleic acids/nucleotide bases, deleting, cleaving, nicking, and/or transcriptional control of a target nucleic acid. In some embodiments, a modification may include an indel of any size and/or a single base change (SNP) of any type.

"Introducing," "introduce," "introduced" (and grammatical variations thereof) in the context of a polynucleotide of interest means presenting a nucleotide sequence of interest (e.g., polynucleotide, a nucleic acid construct, and/or a guide nucleic acid) to a host organism or cell of said organism (e.g., host cell; e.g., a plant cell) in such a manner that the nucleotide sequence gains access to the interior of a cell.

The terms "transformation" or transfection" may be used interchangeably and as used herein refer to the introduction of a heterologous nucleic acid into a cell. Transformation of a cell may be stable or transient. Thus, in some embodiments, a host cell or host organism may be stably transformed with a polynucleotide/nucleic acid molecule of the invention. In some embodiments, a host cell or host organism may be transiently transformed with a nucleic acid construct of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear, mitochondrial and the plastid genomes, and therefore includes integration of the nucleic acid into, for example, the chloroplast or mitochondrial genome. Stable transformation as used herein can also refer to a transgene that is maintained extrachromosomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods. Transformation can also be detected by direct sequencing and/or hybridization protocols well known in the art.

Accordingly, in some embodiments, nucleotide sequences, polynucleotides, nucleic acid constructs, and/or expression cassettes of the invention may be expressed transiently and/or they can be stably incorporated into the genome of the host organism. Thus, in some embodiments, a nucleic acid construct of the invention (e.g., one or more expression cassettes encoding a DNA binding polypeptide or domain, an endonuclease polypeptide or domain, a reverse transcriptase polypeptide or domain, a flap endonuclease polypeptide or domain and/or nucleic acid modifying polypeptide or domain) may be transiently introduced into a cell with a guide nucleic acid and as such, no DNA maintained in the cell.

A nucleic acid construct of the invention can be introduced into a cell by any method known to those of skill in the art. In some embodiments of the invention, transformation of a cell comprises nuclear transformation. In other embodiments, transformation of a cell comprises plastid transformation (e.g., chloroplast transformation). In still further embodiments, the recombinant nucleic acid construct of the invention can be introduced into a cell via conventional breeding techniques.

Procedures for transforming both eukaryotic and prokaryotic organisms are well known and routine in the art and are described throughout the literature (See, for example, Jiang et al. 2013. *Nat. Biotechnol.* 31:233-239; Ran et al. *Nature Protocols* 8:2281--2308 (2013)).

A nucleotide sequence therefore can be introduced into a host organism or its cell in any number of ways that are well known in the art. The methods of the invention do not depend on a particular method for introducing one or more nucleotide sequences into the organism, only that they gain access to the interior of at least one cell of the organism. Where more than one nucleotide sequence is to be introduced, they can be assembled as part of a single nucleic acid construct, or as separate nucleic acid constructs, and can be located on the same or different nucleic acid constructs. Accordingly, the nucleotide sequences can be introduced into the cell of interest in a single transformation event, and/or in separate transformation events, or, alternatively, where relevant, a nucleotide sequence can be incorporated into a plant, for example, as part of a breeding protocol.

Base editing has been shown to be an efficient way to change cytosine and adenine residues to thymine and guanine, respectively. These tools, while powerful, do have some limitations such as bystander bases, small base editing windows, and limited PAMs.

To perform precise templated editing in cells there are several essential steps, each of which has rate limitations that together can severely hamper the ability to effectively perform editing due to low efficiencies. For example, one step requires inducing the cell to initiate a repair event at the target site. This is typically performed by causing a double-strand break (DSB) or nick by an exogenously provided, sequence-specific nuclease or nickase. Another step requires local availability of a homologous template to be used for the repair. This step requires the template to be in the proximity of the DSB at exactly the right time when the DSB is competent to commit to a templated editing pathway. In particular, this step is widely regarded to be the rate limiting step with current editing technologies. A further step is the efficient incorporation of sequence from the template into the broken or nicked target. Prior to the present invention, this step was typically provided by the cell's endogenous DNA repair enzymes. The efficiency of this step is low and difficult to manipulate. The present invention bypasses many of the major obstacles to the efficiency of the process of templated editing by co-localizing, in a coordinate fashion, the functionalities required to carry out the steps described above.

Figure 1:
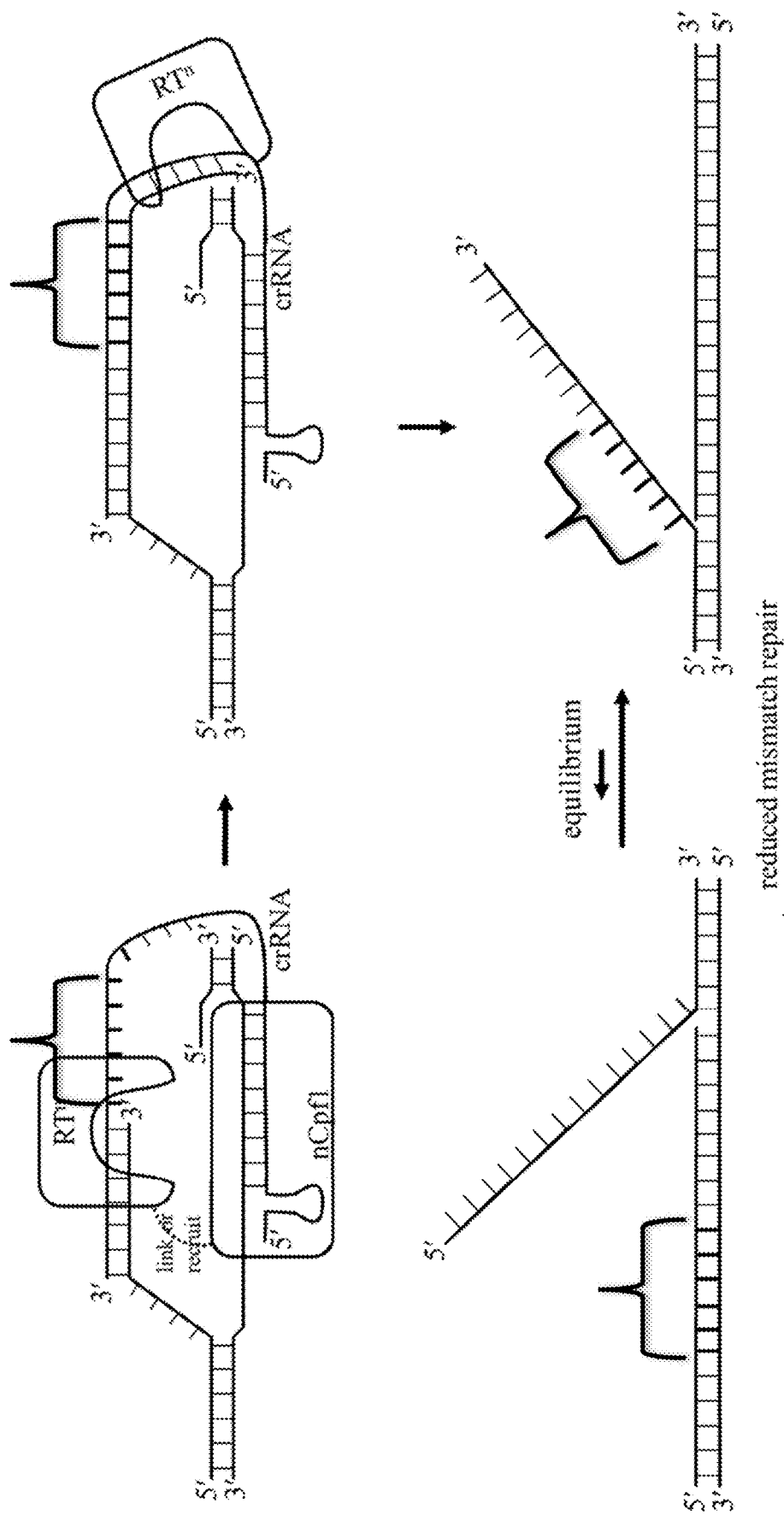
FIG. 1 provides a schematic showing the generation of DNA sequences from reverse transcription off the crRNA and subsequent integration into the nick site. The extended guide crRNA (tagRNA) is bound to the Cpf1 nickase (cas12a nickase) (nCpf1, upper left). Alternatively, the extension encoding the edit template may be located 5' of the crRNA. The 3' end of the crRNA is complimentary to the DNA at the nick site (nonbold pairing lines, upper left). The nCpf1 may be either covalently linked to the reverse transcriptase (RT) or the RT may be recruited to the nCpf1, in which case multiple reverse transcriptase proteins may be recruited to the nCpf1. The RT polymerizes DNA from the 3' end of the DNA nick on the second strand generating a DNA sequence complimentary to the crRNA with nucleotides non-complimentary to the genome (bolded pairing lines, brace, upper right) followed by complimentary nucleotides (non-bold pairing lines, upper right). Upon dissociation, the resultant DNA has an extended ssDNA with a 3' overhang, which is largely the same sequence as the original DNA (non-bolded pairing lines, lower right) but with some non-native nucleotides (bolded pairing lines, brace, lower right). This flap is in equilibrium with a structure having a 5' overhang (lower left) where there are mismatched nucleotides incorporated into the DNA. The equilibrium may be driven toward the structure on the left by reducing mismatch repair, removal of the 5' flap during repair and replication, and also by nicking the first strand as described herein.

FIG. 1 shows the generation of DNA sequences from reverse transcription off the crRNA and subsequent integration into the nick site using methods and constructs of the present invention. An extended crRNA is shown and is bound to the second strand nickase Cpf1 (Cas12a) (nCpf1, upper left). As described in more detail herein, the nCpf1 may be either covalently linked via, for example, a peptide to a reverse transcriptase (RT) or the RT may be recruited to the nCpf1 (e.g., via the use of a peptide tag motif/affinity polypeptide that binds to the peptide tag or via chemical interactions as described herein), in which case multiple reverse transcriptase proteins (RT″) may be recruited. The 3' end of the sgRNA is complimentary to the DNA at the nick site (non-bold pairing lines, upper left). The RT then polymerizes DNA from the 3' end of the DNA nick generating a DNA sequence complimentary to the RNA with nucleotides non-complimentary to the genome (bold pairing lines, brackets, upper right) followed by complimentary nucleotides (non-bold pairing lines, upper right). Upon dissociation, the resultant DNA has an extended ssDNA with a 3' overhang which is largely the same sequence as the original DNA (non-bold pairing lines, lower right) but with some non-native nucleotides (bold pairing lines, brackets, lower right). This flap is in equilibrium with a structure having a 5' overhang (lower left) where there are mismatched nucleotides incorporated into the DNA. This equilibrium lies more to the favorable perfect pairing on the right, but can be driven may be reduced in a variety of ways including, for example, nicking the second strand (e.g., target strand or bottom strand). The structure on the left may be preferentially cleaved by cellular flap endonucleases involved in DNA lagging strand synthesis, which are highly conserved between mammalian and plant cells (the amino acid sequence of *Homo sapiens* FEN1 is over 50% identical to both *Zea mays* and *Glycine max* FEN1). In some embodiments, a flap endonuclease may be introduced to drive the equilibrium in the direction of the 3' flap comprising the non-native/mismatched nucleotides. Longer 5' flaps are often removed in eukaryotic cells by the Dna2 protein, again driving the equilibrium to the 3' flap (desired) product (see, e.g., *Nucleic Acids Res.* 2012 August; 40(14):6774-86).

Figure 2:
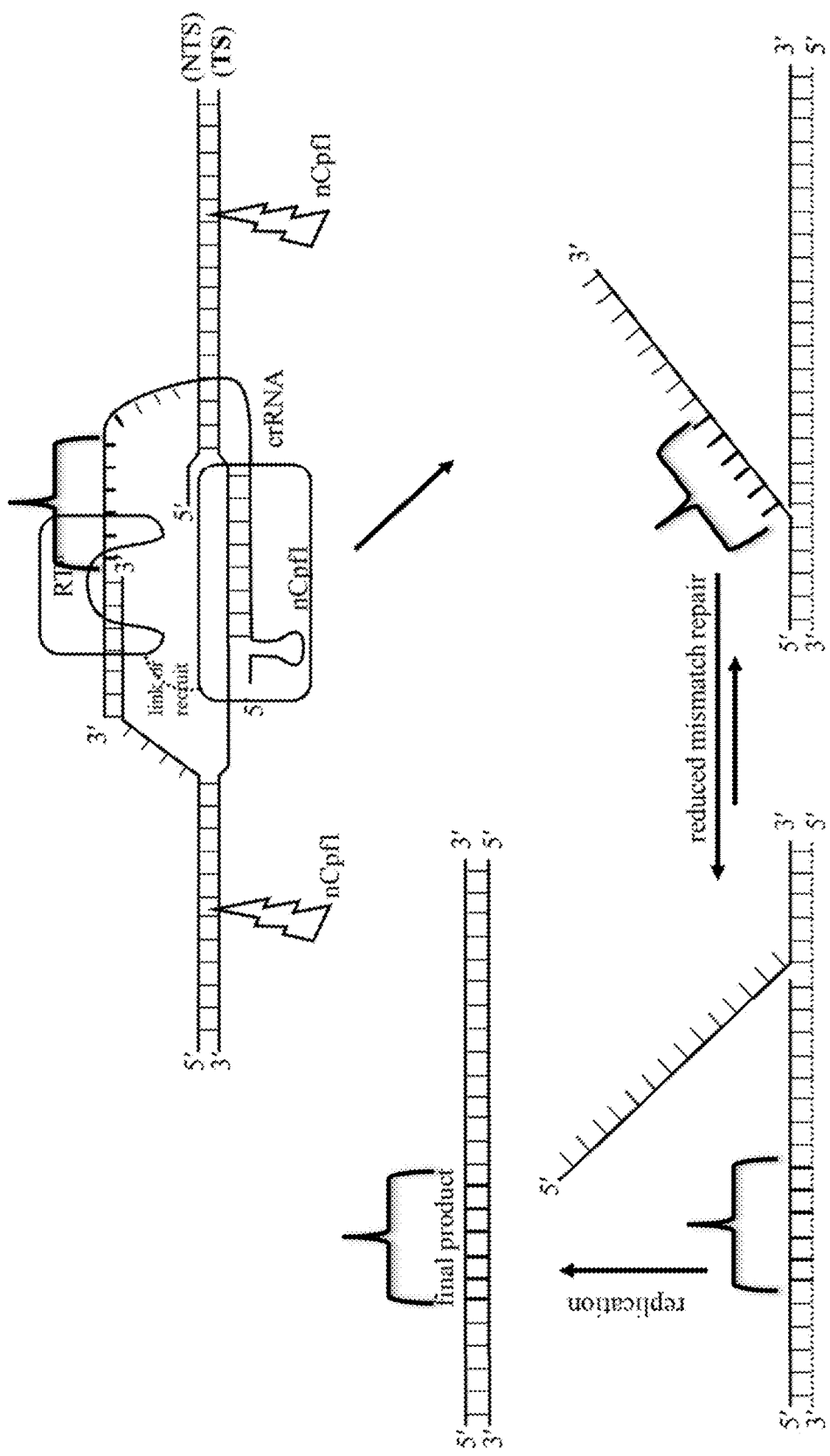
FIG. 2 provides a schematic of showing a method for reducing mismatch repair. In order to drive the equilibrium more favorable for forming the final product with the modified nucleotides (bolded, brace), a nickase is directed (via a guide nucleic acid) to cut the first strand (e.g., target strand or bottom strand) of the target nucleic acid in a region outside of the RT-editing region (lightning bolts)—a distance from the nick in the second strand (e.g., target strand or top strand). The nCpf1:crRNA molecules may be on either side or both sides of the editing bubble. Nicking the first strand (dashed line) indicates to the cell that the newly incorporated nucleotides are the correct nucleotides during mismatch repair and replication, thus favoring a final product with the new nucleotides. Other possible ways of driving the equilibrium toward the desired product can include removal of the 5' flap.
Figure 3:
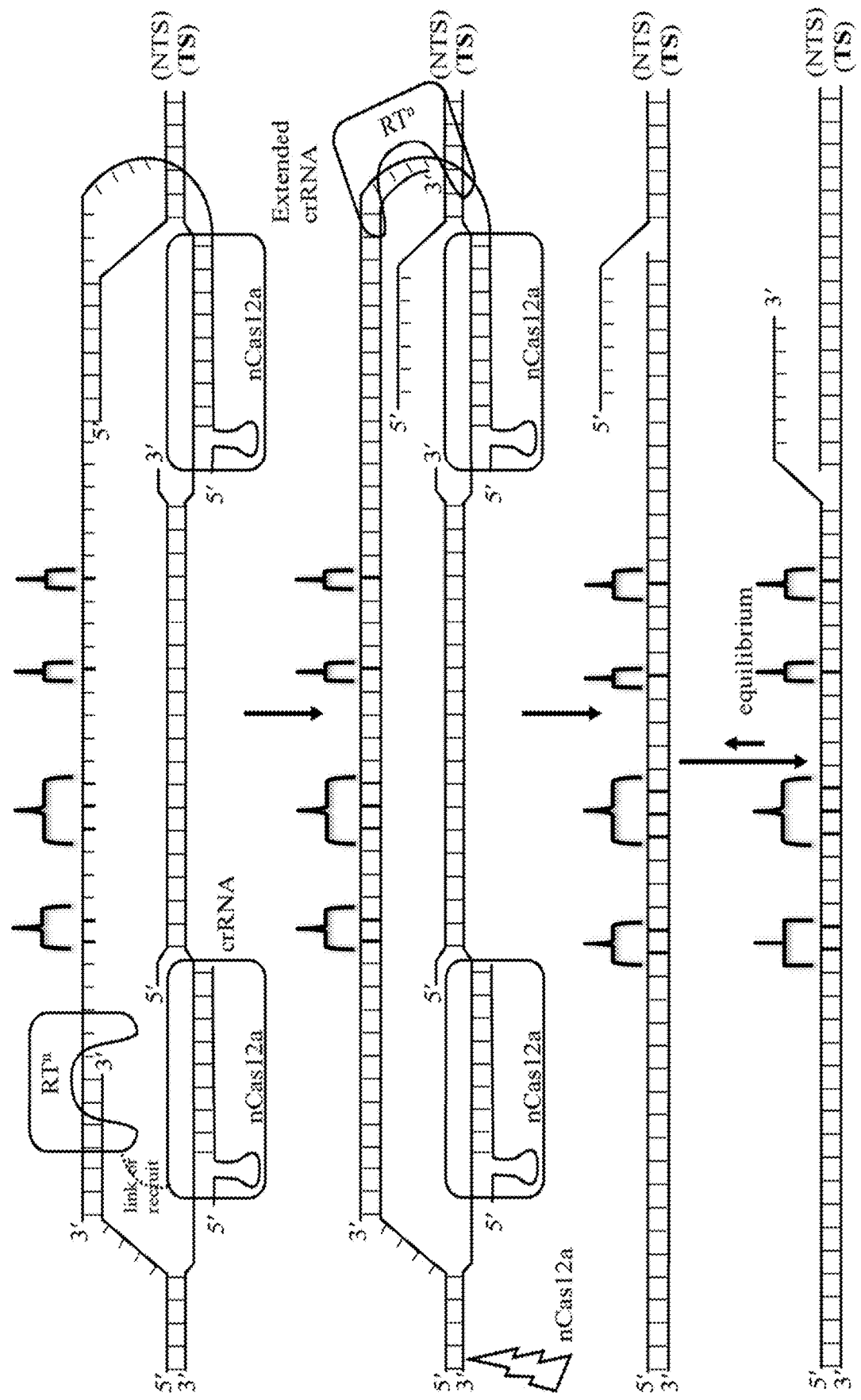
FIG. 3 shows alternative methods of modifying nucleic acids using the compositions of the present invention, wherein in two nicks are introduced in the second strand and the sequence introduced by the RT displaces the double-nicked WT sequence and thereby, is more efficiently incorporated into the genome.

Further in the process of the present invention, and as exemplified in FIG. 2, to reduce mismatch repair and to drive the equilibrium more in favor of forming the final product with the modified nucleotides (bold, brackets), a Cpf1 nickase may be targeted to regions outside of the RT-editing region (lightning bolts) as described herein. The nCpf1:crRNA molecules may be on either side or both sides of the editing bubble. Nicking the first strand (e.g., target strand or bottom strand of FIG. 2) (dashed line) indicates to the cell that the newly incorporated nucleotides are the correct nucleotides during mismatch repair and replication, thus favoring a final product with the new nucleotides.

Variants of the reverse transcriptase (RT) enzyme can have significant effects on the temperature-sensitivity and processivity of the editing system. Natural and rationally- and non-rationally-engineered (i.e., directed evolution) variants of the RT can be useful in optimizing activity in plant-preferred temperatures and for optimizing processivity profiles. Protein domain fusions to an RT polypeptide can have significant effects on the temperature-sensitivity and processivity of the editing system. The RT enzyme can be improved for temperature-sensitivity, processivity, and template affinity through fusions to ssRNA binding domains (RBDs). These RBDs may have sequence specificity, non-specificity or sequence preferences (see, e.g., SEQ ID NOs: 37-52). A range of affinity distributions may be beneficial to editing in different cellular and in vitro environments. RBDs can be modified in both specificity and binding free energy through increasing or decreasing the size of the RBD in order to recognize more or fewer nucleotides. Multiple RBDs result in proteins with affinity distributions that are a combination of the individual RBDs. Adding one or more RBD to the RT enzyme can result in increased affinity, increased or decreased sequence specificity, and/or promote cooperativity.

After reverse transcriptase incorporates an edit into the genome, a sequence redundancy exists between the newly synthesized edited sequence and the original WT sequence it is intended to replace. This leads to either a 5' or 3' flap at the target site, which has to be repaired by the cell. The two states exist in equilibrium with binding energy favoring the 3' flap because more base pairs are available when the WT sequence is paired with its complement than when the edited strand is paired with its complement. This is unfavorable for efficient editing because processing (removal) of the 3' flap may remove the edited residues and revert the target back to WT sequence. However, cellular flap endonucleases such as FEN1 or Dna2 can efficiently process 5' flaps. Thus, instead of relying on the function of 5'-flap endonucleases native to the cell, in some embodiments of this invention the concentration of flap endonucleases at the target may be increased to further favor the desirable equilibrium outcome (removal of the WT sequence in the 5' flap so that the edited sequence becomes stably incorporated at the target site). This may be achieved by overexpression of a 5' flap endonuclease as a free protein in the cell. Alternatively, FEN or Dna2 may be actively recruited to the target site by association with the CRISPR complex, either by direct protein fusion or by non-covalent recruitment such as with a peptide tag and affinity polypeptide pair (e.g., a SunTag antibody/epitope pair) or chemical interactions as described herein.

The present invention further provides method for modifying a target nucleic acid using the proteins/polypeptides, and/or fusion proteins of the invention and polynucleotides and nucleic acid constructs encoding the same, and/or expression cassettes and/or vectors comprising the same. The methods may be carried out in an in vivo system (e.g., in a cell or in an organism) or in an in vitro system (e.g., cell free). Thus, in some embodiments, a method of modifying a target nucleic acid in a plant cell is provided, the method comprising: contacting the target nucleic acid with (a) a Type V CRISPR-Cas effector protein or a Type II CRISPR-Cas effector protein; (b) a reverse transcriptase, and (c) an extended guide nucleic acid (e.g., extended Type II or Type V CRISPR RNA, extended Type II or Type V CRISPR DNA, extended Type II or Type V crRNA, extended Type II or Type V crDNA; e.g., tagRNA, tagDNA), thereby modifying the target nucleic acid. In some embodiments, the Type V CRISPR-Cas effector protein or Type II CRISPR-Cas effector protein, the reverse transcriptase, and the extended guide nucleic acid may form a complex or may be comprised in a complex, which is capable of interacting with the target nucleic acid. In some embodiments, the method of the invention may further comprise contacting the target nucleic acid with: (a) a second Type V CRISPR-Cas effector protein or a second Type II CRISPR-Cas effector protein; (b) a second reverse transcriptase, and (c) a second extended guide nucleic acid (e.g., extended CRISPR RNA, extended CRISPR DNA, extended crRNA, extended crDNA; e.g., tagDNA, tagRNA), wherein the second extended guide nucleic acid targets (spacer is substantially complementary to/binds to) a site on the first strand of the target nucleic acid, thereby modifying the target nucleic acid. In some embodiments, the method of the invention may further comprise contacting the target nucleic acid with: (a) a second Type V CRISPR-Cas effector protein or a second Type II CRISPR-Cas effector protein; (b) a second reverse transcriptase, and (c) a second extended guide nucleic acid (e.g., extended CRISPR RNA, extended CRISPR DNA, extended crRNA, extended crDNA; e.g., tagDNA, tagRNA), wherein the second extended guide nucleic acid targets (spacer is substantially complementary to/binds to) a site on the second strand of the target nucleic acid, thereby modifying the target nucleic acid. In some embodiments, the methods of the invention comprise contacting the target nucleic acid at a temperature of about 20° C. to 42° C. (e.g., about 20, 21, 22, 23, 24, 25, 26, 27, 28, 29, 30, 31, 32, 33, 34, 35, 36, 37, 38, 39, 40, 41, or 42° C., and any value or range therein). In some embodiments, a target nucleic acid may be contacted with additional polypeptides and/or nucleic acid constructs encoding the same in order to improve mismatch repair. In some embodiments, a method of the invention may further comprise contacting the target nucleic acid with (a) a CRISPR-Cas effector protein; and (b) a guide nucleic acid, wherein (i) the CRISPR-Cas effector protein is a nickase (e.g., nCas9, nCas12a) and nicks a site on the first strand of the target nucleic acid that is located about 10 to about 125 base pairs (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, or 125 base pairs, or any range or value therein) that is either 5' or 3' from a site on the second strand that has been nicked by the Type II or Type V CRISPR-Cas effector protein, or (ii) the CRISPR-Cas effector protein is a nickase (e.g., nCas9, nCas12a) and nicks a site on the second strand of the target nucleic acid that is located about 10 to about 125 base pairs (either 5' or 3') from a site on the first strand that has been nicked by the Type II or Type V CRISPR-Cas effector protein, thereby improving mismatch repair.

In some embodiments, an extended guide nucleic acid comprises: (i) a Type V CRISPR nucleic acid or Type II CRISPR nucleic acid (Type II or Type V CRISPR RNA, Type II or Type V CRISPR DNA, Type II or Type V crRNA, Type II or Type V crDNA) and/or a CRISPR nucleic acid and a tracr nucleic acid (e.g., Type II or Type V tracrRNA, Type II or Type V tracrDNA); and (ii) an extended portion comprising a primer binding site and a reverse transcriptase template (RT template). In some embodiments, the extended portion can be fused to either the 5' end or 3' end of the CRISPR nucleic acid (e.g., 5' to 3': repeat-spacer-extended portion, or extended portion-repeat-spacer) and/or to the 5' or 3' end of the tracr nucleic acid. In some embodiments, the extended portion of an extended guide nucleic acid comprises, 5' to 3', an RT template (RTT) and a primer binding site (PBS) or comprises 5' to 3' a PBS and RTT, depending on the location of the extended portion relative to the CRISPR RNA of the guide. In some embodiments, a target nucleic acid is double stranded and comprises a first strand and a second strand and the primer binding site binds to the second strand (non-target, top strand) of the target nucleic acid. In some embodiments, a target nucleic acid is double stranded and comprises a first strand and a second strand and the primer binding site binds to the first strand (e.g., binds to the target strand, same strand to which the CRISPR-Cas effector protein is recruited, bottom strand) of the target nucleic acid. In some embodiments, a target nucleic acid is double stranded and comprises a first strand and a second strand and the primer binding site binds to the second strand (non-target strand, opposite strand from that to which the CRISPR-Cas effector protein is recruited) of the target nucleic acid. Thus, in some embodiments, the editing reverse transcriptase (RT) adds to the target strand (the strand to which the spacer of the CRISPR RNA is complementary and to which the CRISPR-Cas effector protein is recruited) and in some embodiments, the editing reverse transcriptase (RT) adds to the non-target strand (the strand that is complementary to the strand to which the spacer of the CRISPR RNA is complementary and to which the CRISPR-Cas effector protein is recruited).

In some embodiments, a method of modifying a target nucleic acid having a first strand and a second strand is provided, the method comprising: contacting the target nucleic acid with (a) a Type V CRISPR-Cas effector protein or a Type II CRISPR-Cas effector protein; (b) a reverse transcriptase, and (c) an extended guide nucleic acid (e.g., extended Type II or Type V CRISPR RNA, extended Type II or Type V CRISPR DNA, extended Type II or Type V crRNA, extended Type II or Type V crDNA), wherein the extended guide nucleic acid comprises: (i) a Type II or Type V CRISPR nucleic acid (Type II or Type V CRISPR RNA, Type II or Type V CRISPR DNA, Type II or Type V crRNA, Type II or Type V crDNA) and/or a CRISPR nucleic acid and a tracr nucleic acid (e.g., Type II or Type V tracrRNA, Type II or Type V tracrDNA); and (ii) an extended portion comprising a primer binding site and a reverse transcriptase template (RT template), and the Type II or Type V CRISPR nucleic acid comprises a spacer that binds to the first strand (e.g., target strand) (i.e., is complementary to a portion of consecutive nucleotides in the first strand of the target nucleic acid) and the primer binding site binds to the first strand (target strand), thereby modifying the target nucleic acid. In some embodiments, a Type II CRISPR-Cas effector protein can be a Cas9 polypeptide. In some embodiments, a Type V CRISPR-Cas effector protein can be a Cas12a polypeptide. In some embodiments, a Type II or Type V CRISPR-Cas effector protein, a reverse transcriptase, and an extended guide nucleic acid can form a complex or are comprised in a complex. In some embodiments, contacting can further comprise contacting the target nucleic acid with a 5'-3' exonuclease.

In some embodiments, the target nucleic acid may be additionally contacted with a 5' flap endonuclease (FEN), optionally an FEN1 and/or Dna2 polypeptide, thereby improving mismatch repair by removing the 5' flap that does not comprise the edits to be incorporated into the target nucleic acid. In some embodiments, an FEN and/or Dna2 may be overexpressed in the presence of the target nucleic acid. In some embodiments, an FEN may be a fusion protein comprising an FEN domain fused to a Type V CRISPR-Cas effector protein or domain, thereby recruiting the FEN to the target nucleic acid. In some embodiments, a Dna2 may be a fusion protein comprising a Dna2 domain fused to a Type V CRISPR-Cas effector protein or domain, thereby recruiting the Dna2 to the target nucleic acid.

In some embodiments, a Type II or Type V CRISPR-Cas effector protein may be a Type II or Type V CRISPR-Cas fusion protein comprising a Type V CRISPR-Cas effector protein domain fused (linked) to a peptide tag (e.g., an epitope or a multimerized epitope) and an FEN may be an FEN fusion protein comprising an FEN domain fused to an affinity polypeptide that binds to the peptide tag, thereby recruiting the FEN to the Type II or Type V CRISPR-Cas effector protein domain, and the target nucleic acid. In some embodiments, a Type II or Type V CRISPR-Cas effector protein may be a Type II or Type V CRISPR-Cas fusion protein comprising a Type II or Type V CRISPR-Cas effector protein domain fused (linked) to a peptide tag (e.g., an epitope or a multimerized epitope) and a Dna2 may be a Dna2 fusion protein comprising a Dna2 domain fused to an affinity polypeptide that binds to the peptide tag, thereby recruiting the Dna2 to the Type II or Type V CRISPR-Cas effector protein domain, and the target nucleic acid. In some embodiments, a Type V CRISPR-Cas effector protein may be a Type II or Type V CRISPR-Cas fusion protein comprising a Type II or Type V CRISPR-Cas effector protein domain fused (linked) to a peptide tag (e.g., an epitope or a multimerized epitope) and an FEN may be an FEN fusion protein comprising an FEN domain fused to an affinity polypeptide that binds to the peptide tag, thereby recruiting the FEN to the Type II or Type V CRISPR-Cas effector protein domain, and the target nucleic acid. In some embodiments, a Type II or Type V CRISPR-Cas effector protein may be a Type II or Type V CRISPR-Cas fusion protein comprising a Type II or Type V CRISPR-Cas effector protein domain fused (linked) to a peptide tag (e.g., an epitope or a multimerized epitope) and a Dna2 may be a Dna2 fusion protein comprising a Dna2 domain fused to an affinity polypeptide that binds to the peptide tag, thereby recruiting the Dna2 to the Type II or Type V CRISPR-Cas effector protein domain, and the target nucleic acid. In some embodiments, a target nucleic acid may be contacted with two or more FEN fusion proteins and/or Dna2 fusion proteins.

In some embodiments, the methods of the invention may further comprise contacting the target nucleic acid with a 5'-3' exonuclease, thereby improving mismatch repair by removing the 5' flap that does not comprise the edits (non-edited strand) to be incorporated into the target nucleic acid. In some embodiments, a 5'-3' exonuclease may be fused to a Type II or Type V CRISPR-Cas effector protein, optionally to a Type II or Type V CRISPR-Cas fusion protein. In some embodiments, a 5'-3' exonuclease may be a fusion protein comprising the 5'-3' exonuclease fused to a peptide tag and a Type II or Type V CRISPR-Cas effector protein may be a fusion protein comprising a Type II or Type V CRISPR-Cas effector protein domain fused to an affinity polypeptide that is capable of binding to the peptide tag, thereby improving mismatch repair. In some embodiments, a 5'-3' exonuclease may be a fusion protein comprising a 5'-3' exonuclease fused to an affinity polypeptide that is capable of binding to the peptide tag and a Type II or Type V CRISPR-Cas effector protein may be a fusion protein comprising a Type II or Type V CRISPR-Cas effector protein domain fused to a peptide tag. In some embodiments, a 5'-3' exonuclease may be a fusion protein comprising a 5'-3' exonuclease fused to an affinity polypeptide that is capable of binding to an RNA recruiting motif and the extended guide nucleic acid is linked to an RNA recruiting motif, thereby recruiting the 5'-3' exonuclease to the target nucleic acid via interaction between the affinity polypeptide and RNA recruiting motif. A 5'-3' exonuclease may be any known or later discovered 5'-3' exonuclease functional in the organism, cell or in vitro system of interest. In some embodiments, a 5'-3' exonuclease can include but is not limited to, a RecE exonuclease, a RecJ exonuclease, a T5 exonuclease, and/or a T7 exonuclease. In some embodiments, a RecE exonuclease C-terminal fragment flanked on both sides with nuclear localization sequences (NLS) from, for example, *Escherichia coli* (strain K12) may be used (SEQ ID NO:98). In some embodiments, a RecJ exonuclease flanked on both sides with nuclear localization sequences (NLS) from, for example, *Escherichia coli* (strain K12) may be used (SEQ ID NO:99). In some embodiments, a T5 exonuclease flanked on both sides with nuclear localization sequences (NLS) may be used (SEQ ID NO:100).). In some embodiments, a T7 exonuclease flanked on both sides with nuclear localization sequences (NLS) from, for example, *Escherichia* phage 7 may be used (SEQ ID NO:101).

In some embodiments, the methods of the invention may further comprise reducing double strand breaks. In some embodiments, reducing double strand breaks may be carried out by introducing, in the region of the target nucleic acid, a chemical inhibitor of non-homologous end joining (NHEJ), or by introducing a CRISPR guide nucleic acid, or an siRNA targeting an NHEJ protein to transiently knock-down expression of the NHEJ protein.

In some embodiments, a Type II or Type V CRISPR-Cas effector protein may be a fusion protein and/or the reverse transcriptase may be a fusion protein, wherein the Type II or Type V CRISPR-Cas fusion protein, the reverse transcriptase fusion protein and/or the extended guide nucleic acid may be fused to one or more components, which allow for the recruiting the reverse transcriptase to the Type II or Type V CRISPR-Cas effector protein. In some embodiments, the one or more components recruit via protein-protein interactions, protein-RNA interactions, and/or chemical interactions.

Thus, in some embodiments, a Type V CRISPR-Cas effector protein may be a Type V CRISPR-Cas effector fusion protein comprising a Type V CRISPR-Cas effector protein domain fused (linked) to a peptide tag (e.g., an epitope or a multimerized epitope) and the reverse transcriptase may be a reverse transcriptase fusion protein comprising a reverse transcriptase domain fused (linked) to an affinity polypeptide that binds to the peptide tag, wherein the Type V CRISPR-Cas effector protein interacts with the guide nucleic acid, which guide nucleic acid binds to the target nucleic acid, thereby recruiting the reverse transcriptase to the Type V CRISPR-Cas effector protein and to the target nucleic acid. In some embodiments, the Type II CRISPR-Cas effector protein is a Type II CRISPR-Cas fusion protein comprising a Type II CRISPR-Cas effector protein domain fused (linked) to a peptide tag (e.g., an epitope or a multimerized epitope) and the FEN is an FEN fusion protein comprising an FEN domain fused to an affinity polypeptide that binds to the peptide tag, and/or wherein the Type II CRISPR-Cas effector protein is a Type II CRISPR-Cas fusion protein comprising a Type II CRISPR-Cas effector protein domain fused to a peptide tag and the Dna2 polypeptide is an Dna2 fusion protein comprising an Dna2 domain fused to an affinity polypeptide that binds to the peptide tag, optionally wherein the target nucleic acid is contacted with two or more FEN fusion proteins and/or two or more Dna2 fusion proteins, thereby recruiting the FEN and/or Dna2 to the Type II CRISPR-Cas effector protein domain, and the target nucleic acid. In some embodiments, two or more reverse transcriptase fusion proteins may be recruited to the Type II or Type V CRISPR-Cas effector protein, thereby contacting the target nucleic acid with two or more reverse transcriptase fusion proteins.

A peptide tag may include, but is not limited to, a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope. Any epitope that may be linked to a polypeptide and for which there is a corresponding affinity polypeptide that may be linked to another polypeptide may be used with this invention. In some embodiments, a peptide tag may comprise 1 or 2 or more copies of a peptide tag (e.g., epitope, multimerized epitope (e.g., tandem repeats)) (e.g., 1, 2, 3, 4, 5, 6, 7, 8, 9, 10, 11, 12, 13, 14, 15, 16, 17, 18, 19, 20, 21, 22, 23, 24, 25 or more peptide tags. In some embodiments, an affinity polypeptide that binds to a peptide tag may be an antibody. In some embodiments, the antibody may be a scFv antibody. In some embodiments, an affinity polypeptide that binds to a peptide tag may be synthetic (e.g., evolved for affinity interaction) including, but not limited to, an affibody, an anticalin, a monobody and/or a DARPin (see, e.g., Sha et al., *Protein Sci.* 26(5):910-924 (2017)); Gilbreth (*Curr Opin Struc Biol* 22(4):413-420 (2013)), U.S. Pat. No. 9,982,053, each of which are incorporated by reference in their entireties for the teachings relevant to affibodies, anticalins, monobodies and/or DARPins. Example peptide tag sequences and their affinity polypeptides include, but are not limited to, the amino acid sequences of SEQ ID NOs:23-25.

In some embodiments, an extended guide nucleic acid may be linked to an RNA recruiting motif, and the reverse transcriptase may be a reverse transcriptase fusion protein, wherein the reverse transcriptase fusion protein may comprise a reverse transcriptase domain fused to an affinity polypeptide that binds to the RNA recruiting motif, wherein the extended guide binds to the target nucleic acid and the RNA recruiting motif binds to the affinity polypeptide, thereby recruiting the reverse transcriptase fusion protein to the extended guide and contacting the target nucleic acid with the reverse transcriptase domain. In some embodiments, two or more reverse transcriptase fusion proteins may be recruited to an extended guide nucleic acid, thereby contacting the target nucleic acid with two or more reverse transcriptase fusion proteins. Example RNA recruiting motifs and their affinity polypeptides include, but are not limited to, the sequences of SEQ ID NOs:26-36.

In some embodiments, an RNA recruiting motif may be located on the 3' end of the extended portion of the extended guide nucleic acid (e.g., 5'-3', repeat-spacer-extended portion (RT template-primer binding site)-RNA recruiting motif). In some embodiments, an RNA recruiting motif may be embedded in the extended portion.

In some embodiments of the invention, an extended guide RNA and/or guide RNA may be linked to one or to two or more RNA recruiting motifs (e.g., 1, 2, 3, 4, 5, 6, 7, 8, 9, 10 or more motifs; e.g., at least 10 to about 25 motifs), optionally wherein the two or more RNA recruiting motifs may be the same RNA recruiting motif or different RNA recruiting motifs. In some embodiments, an RNA recruiting motif and corresponding affinity polypeptide may include, but is not limited, to a telomerase Ku binding motif (e.g., Ku binding hairpin) and the corresponding affinity polypeptide Ku (e.g., Ku heterodimer), a telomerase Sm7 binding motif and the corresponding affinity polypeptide Sm7, an MS2 phage operator stem-loop and the corresponding affinity polypeptide MS2 Coat Protein (MCP), a PP7 phage operator stem-loop and the corresponding affinity polypeptide PP7 Coat Protein (PCP), an SfMu phage Com stem-loop and the corresponding affinity polypeptide Com RNA binding protein, a PUF binding site (PBS) and the affinity polypeptide Pumilio/fem-3 mRNA binding factor (PUF), and/or a synthetic RNA-aptamer and the aptamer ligand as the corresponding affinity polypeptide. In some embodiments, the RNA recruiting motif and corresponding affinity polypeptide may be an MS2 phage operator stem-loop and the affinity polypeptide MS2 Coat Protein (MCP). In some embodiments, the RNA recruiting motif and corresponding affinity polypeptide may be a PUF binding site (PBS) and the affinity polypeptide Pumilio/fem-3 mRNA binding factor (PUF).

In some embodiments, the components for recruiting polypeptides and nucleic acids may those that function through chemical interactions that may include, but are not limited to, rapamycin-inducible dimerization of FRB—FKBP; Biotin-streptavidin; SNAP tag; Halo tag; CLIP tag; DmrA-DmrC heterodimer induced by a compound; bifunctional ligand (e.g., fusion of two protein-binding chemicals together; e.g. dihyrofolate reductase (DHFR).

In some embodiments of the invention, a CRISPR-Cas effector protein (e.g., a CRISPR-Cas effector protein, a first CRISPR-Cas effector protein, a second CRISPR-Cas effector protein, a third CRISPR-Cas effector protein, and/or a fourth CRISPR-Cas effector protein) may be from a Type I CRISPR-Cas system, a Type II CRISPR-Cas system, a Type III CRISPR-Cas system, a Type IV CRISPR-Cas system and/or a Type V CRISPR-Cas system. In some embodiments, the CRISPR-Cas nuclease is from a Type II CRISPR-Cas system or a Type V CRISPR-Cas system.

In some embodiments of the invention, a CRISPR-Cas effector protein may be a Cas9, C2c1, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5 nuclease, optionally wherein the CRISPR-Cas nuclease may be a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or Cas14c nuclease.

In some embodiments, a CRISPR-Cas effector protein may be a protein that functions as a nickase (e.g., a Cas9 nickase or a Cas12a nickase). In some embodiments, a CRISPR-Cas effector protein useful with the invention may comprise a mutation in its nuclease active site (e.g., RuvC, HNH, e.g., RuvC site of a Cas12a nuclease domain; e.g., RuvC site and/or HNH site of a Cas9 nuclease domain). A CRISPR-Cas effector protein having a mutation in its nuclease active site, and therefore, no longer comprising nuclease activity, is commonly referred to as "dead," or "deactivated" e.g., dCas. In some embodiments, a CRISPR-Cas nuclease domain or polypeptide having a mutation in its nuclease active site may have impaired activity or reduced activity as compared to the same CRISPR-Cas nuclease without the mutation. In some embodiments, a CRISPR-Cas effector protein useful with the invention may be a double stranded nuclease. In some embodiments, a CRISPR-Cas effector protein having double stranded nuclease activity may be a Type II or a Type V CRISPR-Cas effector protein. In some embodiments, a Type V CRISPR-Cas effector protein having double stranded nuclease activity is a Cas12a polypeptide. In some embodiments, a Type II CRISPR-Cas effector protein having double stranded nuclease activity is a Cas9 polypeptide.

In some embodiments, a CRISPR-Cas effector protein may be a Type V CRISPR-Cas effector protein. In some embodiments, a Type V CRISPR-Cas effector protein may comprise a Cas12a (Cpf1), Cas12b (C2c1), Cas12c (C2c3), Cas12d (CasY), Cas12e (CasX), Cas12g, Cas12h, Cas12i, C2c4, C2c5, C2c8, C2c9, C2c10, Cas14a, Cas14b, and/or Cas14c effector protein and/or domain.

In some embodiments, a Type V CRISPR-Cas system may comprise an effector protein that utilizes a Type V CRISPR nucleic acid only. In some embodiments, a Type V CRISPR-Cas system may comprise an effector protein that, similar to Type II CRISPR-Cas systems, utilize both a CRISPR nucleic acid and a trans-activating CRISPR (tracr) nucleic acid. Thus, in some embodiments, a Type V CRISPR-Cas effector protein useful with the present invention may function with a corresponding CRISPR nucleic acid only (e.g., Cas12a, Cas12a, Cas12i, Cas12h, Cas14b, Cas14c, C2c10, C2c9, C2c8, C2c4). In some embodiments, a Type V CRISPR-Cas effector protein useful with the present invention may function with a corresponding CRISPR nucleic acid and tracr nucleic acid (e.g., Cas12b, Cas12c, Cas12e, Cas12g, Cas14a).

A CRISPR nucleic acid useful with this invention may comprise at least one repeat sequence that is capable of interacting with a corresponding Type V CRISPR-Cas effector protein, and at least one spacer sequence, wherein the at least one spacer sequence is capable of binding a target nucleic acid (e.g., a first strand or a second strand of the target nucleic acid). In some embodiments, a repeat sequence of a CRISPR nucleic acid may be located 5' to the spacer sequence. In some embodiments, CRISPR nucleic acid may comprise more than one repeat sequence, wherein the repeat sequence is linked to both the 5' end and the 3' end of the spacer. In some embodiments, a CRISPR nucleic acid useful with this invention may comprise two or more repeat and one or more spacer sequences, wherein each spacer sequence is linked at the 5' end and the 3' end with a repeat sequence.

A tracr nucleic acid useful with this invention may comprises a first portion that is substantially complementary to and hybridizes to the repeat sequence of a corresponding CRISPR nucleic acid and a second portion that interacts with a corresponding Type II or a Type V CRISPR-Cas effector protein.

In some embodiments, a Type V CRISPR-Cas effector protein useful for this invention may function as a double stranded DNA nuclease. In some embodiments, a Type V CRISPR-Cas effector protein may function as a single stranded DNA nickase, optionally wherein the first strand is nicked. In some embodiments, a Type V CRISPR-Cas effector protein may function as a single stranded DNA nickase, optionally wherein the second strand is nicked. In some embodiments, the Type V CRISPR-Cas effector protein may be a Cas12a effector protein that functions as a nickase, optionally wherein the first strand (target strand) is nicked. In some embodiments, the Type V CRISPR-Cas effector protein may be a Cas12a effector protein that functions as a nickase, optionally wherein the second strand is nicked.

In some embodiments, a Cas12a effector protein may be a Cas12a nickase having a mutation of the arginine in the LQMRNS motif. A mutation of the arginine in this motif may be to any amino acid, thereby providing a Cas12a nickase. In some embodiments, the mutation may be to an alanine. In some embodiments, the mutation may be to an alanine, asparagine, aspartic acid, cysteine, glutamic acid, glutamine, glycine, histidine, isoleucine, leucine, lysine, methionine, phenylalanine, proline, serine, threonine, tryptophan, tyrosine, or valine. In some embodiments, the mutation may be a mutation to an alanine. In some embodiments, the mutation does not include a mutation to a lysine or a histidine. In some embodiments, a Cas12a effector protein may be an LbCas12a nickase comprising an R1138, optionally a R1138A mutation (see reference nucleotide sequence SEQ ID NO:9), an R1137 mutation, optionally a R1137A mutation (see reference nucleotide sequence SEQ ID NO:1), or an R1124 mutation, optionally a R1124A mutation (see reference nucleotide sequence SEQ ID NO:7). In some embodiments, a Cas12a effector protein may be an AsCas12a nickase comprising an R1226 mutation, optionally an R1226A mutation (see reference nucleotide sequence SEQ ID NO:2). In some embodiments, a Cas12a effector protein may be a FnCas12a nickase comprising an R1218 mutation, optionally an R1218A mutation (see reference nucleotide sequence SEQ ID NO:6. In some embodiments, a Cas12a effector protein may be a PdCas12a nickase comprising an R1241 mutation, optionally an R1241A mutation (see reference nucleotide sequence SEQ ID NO:14.

In some embodiments, a Type V CRISPR-Cas effector protein useful with this invention may comprise reduced single stranded DNA cleavage activity (ss DNAse activity) (e.g., the Type V CRISPR-Cas effector protein may be modified (mutated) to reduce ss DNAse activity (e.g., about 10, 15, 20, 25, 30, 35, 40, 45, 50, 55, 60, 65, 70, 75, 80, 85, 90, 95, 96, 97, 98, 99, or 100% less ss DNAse activity than a wild-type or non-modified Type V CRISPR-Cas effector protein).

In some embodiments, a Type V CRISPR-Cas effector protein useful with this invention may comprise reduced self-processing RNAse activity (e.g., the Type V CRISPR-Cas effector protein may be modified (mutated) to reduce self-processing RNAse activity (e.g., about 10, 15, 20, 25, 30, 35, 40, 45, 50, 55, 60, 65, 70, 75, 80, 85, 90, 95, 96, 97, 98, 99, or 100% less self-processing RNAse activity than a wild-type or non-modified Type V CRISPR-Cas effector protein). In some embodiments, a mutation to reduce self-processing RNAse activity may be a mutation of an histidine at residue position 759 with reference to nucleotide position numbering of SEQ ID NO:9, optionally a mutation of a histidine to alanine (H759A).

In some embodiments, a Type V CRISPR-Cas effector protein or domain useful with the invention may comprise a mutation in its nuclease active site (e.g., RuvC of a dType V CRISPR-Cas effector protein or domain, e.g., RuvC site of a Cas12a nuclease domain). A CRISPR-Cas nuclease having a mutation in its nuclease active site, and therefore, no longer comprising nuclease activity, is commonly referred to as "deactivated" or "dead," e.g., dCas, dCas12a. In some embodiments, a CRISPR-Cas nuclease domain or polypeptide having a mutation in its nuclease active site may have impaired activity or reduced activity as compared to the same CRISPR-Cas nuclease without the mutation. In some embodiments, deactivated Type V CRISPR-Cas effector protein may function as a nickase (a first strand nickase and/or a second strand nickase).

In some embodiments, a Type V CRISPR-Cas effector protein may be a Type V CRISPR-Cas fusion protein, wherein the Type V CRISPR-Cas fusion protein comprises a Type V CRISPR-Cas effector protein domain fused to a reverse transcriptase. In some embodiments, the reverse transcriptase may be fused to the C-terminus of the Type V CRISPR-Cas effector polypeptide. In some embodiments, the reverse transcriptase may be fused to the N-terminus of the Type V CRISPR-Cas effector polypeptide.

In some embodiments, a Type V CRISPR-Cas effector protein may be a Type V CRISPR-Cas fusion protein, wherein the Type V CRISPR-Cas fusion protein comprises a Type V CRISPR-Cas effector protein domain fused to a nicking enzyme (e.g., Fok1, BFi1, e.g., an engineered Fok1 or BFiI), optionally wherein the Type V CRISPR-Cas effector protein domain may be a deactivated Type V CRISPR-Cas domain fused to the nicking enzyme.

In some embodiments, a Type II CRISPR-Cas effector protein may be a Type II CRISPR-Cas fusion protein, wherein the Type II CRISPR-Cas fusion protein comprises a Type II CRISPR-Cas effector protein domain fused to a reverse transcriptase. In some embodiments, the reverse transcriptase may be fused to the C-terminus of the Type II CRISPR-Cas effector polypeptide. In some embodiments, the reverse transcriptase may be fused to the N-terminus of the Type II CRISPR-Cas effector polypeptide. In some embodiments, a Type II CRISPR-Cas effector protein may be a Type II CRISPR-Cas fusion protein, wherein the Type II CRISPR-Cas fusion protein comprises a Type II CRISPR-Cas effector protein domain fused to a nicking enzyme (e.g., Fok1, BFi1, e.g., an engineered Fok1 or BFiI), optionally wherein the Type II CRISPR-Cas effector protein domain may be a deactivated Type II CRISPR-Cas domain fused to the nicking enzyme.

In some embodiments, a reverse transcriptase useful with this invention may be a wild type reverse transcriptase. In some embodiments, a reverse transcriptase useful with this invention may be a synthetic reverse transcriptase, see, e.g., Heller et al. *Nucleic Acids Research*, 47(7) 3619-3630 (2019)).

In some embodiments, a reverse transcriptase useful with this invention may be modified to improve the transcription function of the reverse transcriptase. The transcription function of a reverse transcriptase may be improved by improving the processivity of the reverse transcriptase, e.g., increase the ability of the reverse transcriptase to polymerize more DNA bases during a single binding event to the template (e.g., before it falls off the template) (e.g., increase processivity by about 5, 10, 15, 20, 25, 30, 345, 40, 45, 50, 55, 60, 65, 70, 75, 80, 85, 90, 95, 96, 97, 98, 99, or 100% as compared to the reference reverse transcriptase that has not been modified).

In some embodiments, transcription function of a reverse transcriptase may be improved by improving the template affinity of the reverse transcriptase (e.g., increase template affinity by about 5, 10, 15, 20, 25, 30, 345, 40, 45, 50, 55, 60, 65, 70, 75, 80, 85, 90, 95, 96, 97, 98, 99, or 100% as compared to the reference reverse transcriptase that has not been modified).

In some embodiments, transcription function of a reverse transcriptase may be improved by improving the thermostability of the reverse transcriptase for improved performance at a desired temperature (e.g., increase thermostability by about 5, 10, 15, 20, 25, 30, 345, 40, 45, 50, 55, 60, 65, 70, 75, 80, 85, 90, 95, 96, 97, 98, 99, or 100% as compared to the reference reverse transcriptase that has not been modified). In some embodiments, the improved thermostability is at a temperature of about 20° C. to 42° C. (e.g., about 20, 21, 22, 23, 24, 25, 26, 27, 28, 29, 30, 31, 32, 33, 34, 35, 36, 37, 38, 39, 40, 41, or 42° C., and any value or range therein). In some embodiments, a reverse transcriptase having improved thermostability may include, but is not limited to, M-MuLV trimutant D200N+L603W+T330P or M-MuLV pentamutant D200N+L603W+T330P+T306K+W313F (reference sequence SEQ ID NO:53). See, e.g., Baranauskas et al. (*Protein Eng. Des. Sel.* 25, 657-668 (2012)); Anzalone et al. (*Nature* 576:149-157 (2019)).

In some embodiments of the invention, a reverse transcriptase may be fused to one or more single stranded RNA binding domains (RBDs). RBDs useful with the invention may include, but are not limited to, SEQ ID NOS:37-52 (SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, and/or SEQ ID NO:52), thereby improving the thermostability, processivity and template affinity of the reverse transcriptase.

In some embodiments, the activity of a reverse transcriptase may be modified for (Type V or Type II) gene editing activity to provide optimal activity in association with a Type V or Type II CRISPR-Cas effector polypeptide (e.g., an increase in activity when associated with a Type V CRISPR-Cas effector polypeptide by about 5, 10, 15, 20, 25, 30, 345, 40, 45, 50, 55, 60, 65, 70, 75, 80, 85, 90, 95, 96, 97, 98, 99, or 100% as compared to the reference reverse transcriptase that has not been modified). Such mutations include those that affect or improve RT initiation, processivity, enzyme kinetics, temperature sensitivity, and/or error rate.

The polypeptides/proteins/domains of this invention (e.g., a CRISPR-Cas effector protein e.g., a Type II or Type V CRISPR-Cas effector protein), a reverse transcriptase, a 5' flap endonuclease, and/or a 5'-3' exonuclease) may be encoded by one or more polynucleotides, optionally operably linked to one or more promoters and/or other regulatory sequences (e.g., terminator, operon, and/or enhancer and the like). In some embodiments, the polynucleotides of this invention may be comprised in one or more expression cassettes and/or vectors. In some embodiments, the at least one regulatory sequence may be, for example, a promoter, an operon, a terminator, or an enhancer. In some embodiments, the at least one regulatory sequence may be a promoter. In some embodiments, the regulatory sequence may be an intron. In some embodiments, the at least one regulatory sequence may be, for example, a promoter operably associated with an intron or a promoter region comprising an intron. In some embodiments, the at least one regulatory sequence may be, for example a ubiquitin promoter and its associated intron (e.g., *Medicago truncatula* and/or *Zea mays* and their associated introns) (e.g., ZmUbi1 comprising an intron; MtUb2 comprising an intron, e.g., SEQ ID NOs:21 or 22) or a promoter comprising an intron of SEQ ID NOs:74 or 75).

In some embodiments, the present invention provides a polynucleotide encoding a Type II CRISPR-Cas effector protein or domain or a Type V CRISPR-Cas effector protein or domain, a polynucleotide encoding a CRISPR-Cas effector protein or domain, a polynucleotide encoding a reverse transcriptase polypeptide or domain, a polynucleotide encoding a 5'-3' exonuclease polypeptide or domain and/or a polynucleotide encoding a flap endonuclease polypeptide or domain operably associated with one or more promoter regions that comprise or are associated with an intron, optionally wherein the promoter region may be a ubiquitin promoter and intron ((e.g., a *Medicago* or a *maize* ubiquitin promoter and intron, e.g., SEQ ID NOs:21 or 22) or a promoter comprising an intron of SEQ ID NOs:74 or 75).

In some embodiments, a polynucleotide encoding a Type II or Type V CRISPR-Cas effector protein and/or a polynucleotide encoding a reverse transcriptase may be comprised in the same or separate expression cassettes, optionally when the polynucleotide encoding the Type II or Type V CRISPR-Cas effector protein and the polynucleotide encoding the reverse transcriptase are comprised in the same expression cassette, the polynucleotide encoding the Type II or Type V CRISPR-Cas effector protein and the polynucleotide encoding the reverse transcriptase may be operably linked to a single promoter or to two or more separate promoters in any combination. In some embodiments, a polynucleotide encoding a CRISPR-Cas effector protein may be comprised in an expression cassette, wherein the polynucleotide encoding the CRISPR-Cas effector protein may be operably linked to a promoter.

In some embodiments, an extended guide nucleic acid and/or guide nucleic acid may be comprised in an expression cassette, optionally wherein the expression cassette is comprised in a vector. In some embodiments, an expression cassette and/or vector comprising the extended guide nucleic acid may be the same or a different expression cassette and/or vector from that comprising the polynucleotide encoding the Type II or Type V CRISPR-Cas effector protein and/or the polynucleotide encoding the reverse transcriptase.

In some embodiments, an expression cassette and/or vector comprising the guide nucleic acid may be the same or a different expression cassette and/or vector from that comprising the polynucleotide encoding the CRISPR-Cas effector protein.

In some embodiments, a polynucleotide encoding a 5' flap endonuclease and/or a polynucleotide encoding a 5'-3' exonuclease may be comprised in one or more expression cassettes, which may be the same or different expression cassettes. In some embodiments, an expression cassette comprising a polynucleotide encoding a 5' flap endonuclease and/or a polynucleotide encoding a 5'-3' exonuclease may be the same or different expression cassette from that comprising a polynucleotide encoding a Type II or Type V CRISPR-Cas effector protein, a polynucleotide encoding a Type II or Type V CRISPR-Cas effector protein and/or a polynucleotide encoding a reverse transcriptase.

In some embodiments of the invention, polynucleotides encoding CRISPR-Cas effector proteins (e.g., a Type II CRISPR-Cas effector protein, a Type V CRISPR-Cas effector protein), reverse transcriptase, flap endonucleases, 5'-3' exonucleases, and fusion proteins comprising the same and nucleic acid constructs, expression cassettes and/or vectors comprising the polynucleotides may be codon optimized for expression in an organism (e.g., an animal (e.g., a mammal, an insect, a fish, and the like), a plant (e.g., a dicot plant, a monocot plant), a bacterium, an archaeon, and the like). In some embodiments, the polynucleotides, expression cassettes, and/or vectors may be codon optimized for expression in a plant, optionally a dicot plant or a monocot plant. Exemplary mammals for which this invention may be useful include, but are not limited to, primates (human and non-human (e.g., a chimpanzee, baboon, monkey, gorilla, etc.)), cats, dogs, ferrets, gerbils, hamsters, cows, pigs, horses, goats, donkeys, or sheep.

In some embodiments, the polynucleotides, nucleic acid constructs, expression cassettes or vectors of the invention that are optimized for expression in an organism may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the nucleic acid constructs, expression cassettes or vectors encoding the same but which have not been codon optimized for expression in a plant.

In some embodiments, polynucleotides, nucleic acid constructs, expression cassettes and vectors may be provided for carrying out the methods of the invention. Thus, in some embodiments an expression cassette is provided that is codon optimized for expression in an organism, comprising 5' to 3' (a) polynucleotide encoding a promoter sequence, (b) a polynucleotide encoding a Type V CRISPR-Cas nuclease (e.g., Cpf1 (Cas12a), dCas12a and the like) or a Type II CRISPR-Cas nuclease (e.g., Cas9, dCas9 and the like) that is codon-optimized for expression in the organism; (c) a linker sequence; and (d) a polynucleotide encoding a reverse transcriptase that is codon-optimized for expression in the organism. In some embodiments, the organism is an animal, a plant, a fungus, an archaeon, or a bacterium.

In some embodiments, the organism is a plant and the polynucleotide encoding a Type V CRISPR-Cas nuclease is codon optimized for expression in a plant, and the promoter sequence is a plant specific promoter sequence (e.g. ZmUbi1, MtUb2, RNA polymerase II (Pol II)).

In some embodiments, polynucleotides, nucleic acid constructs, expression cassettes and vectors may be provided for carrying out the methods of the invention. Thus, in some embodiments an expression cassette is provided that is codon optimized for expression in a plant, comprising 5' to 3' (a) polynucleotide encoding a plant specific promoter sequence (e.g. ZmUbi1, MtUb2, RNA polymerase II (Pol II)), (b) a plant codon-optimized polynucleotide encoding a Type II or Type V CRISPR-Cas effector protein (e.g., Cpf1 (Cas12a), dCas12a and the like), (c) a linker sequence; and (d) a plant codon-optimized polynucleotide encoding a reverse transcriptase.

In some embodiments, polypeptides of the invention may be fusion proteins comprising one or more polypeptides linked to one another via a linker. In some embodiments, the linker may be an amino acid or peptide linker. In some embodiments, a peptide linker may be about 2 to about 100 amino acids (residues) in length, as described herein. In some embodiments, a peptide linker may be, for example, a GS linker.

In some embodiments, the invention provides an expression cassette that is codon optimized for expression in a plant, comprising: (a) a polynucleotide encoding a plant specific promoter sequence (e.g. ZmUbi1, MtUb2), and (b) an extended guide nucleic acid sequence, wherein the extended guide nucleic acid comprises an extended portion comprising at its 3' end a primer binding site and an edit to be incorporated into the target nucleic acid (e.g., reverse transcriptase template) (e.g., 5'-3'-crRNA-RTT-PBS), optionally wherein the extended guide nucleic acid is comprised in an expression cassette, optionally wherein the extended guide nucleic acid is operably linked to a Pol II promoter. In some embodiments, when the extended portion of the guide nucleic acid is attached to a CRISPR RNA at the 5' end, the extended portion comprises at its 5' end a primer binding site and an edit to be incorporated into the target nucleic acid (e.g., reverse transcriptase template) at the 3' end (5'-3'-PBS-RTT-crRNA).

In some embodiments, an expression cassette of the invention may be codon optimized for expression in a dicot plant or for expression in a monocot plant. In some embodiments, the expression cassettes of the invention may be used in a method of modifying a target nucleic acid in a plant or plant cell, the method comprising introducing one or more expression cassettes of the invention into a plant or plant cell, thereby modifying the target nucleic acid in the plant or plant cell to produce a plant or plant cell comprising the modified target nucleic acid. In some embodiments, the method may further comprise regenerating the plant cell comprising the modified target nucleic acid to produce a plant comprising the modified target nucleic acid.

A CRISPR Cas9 polypeptide or CRISPR Cas9 domain (e.g., a Type II CRISPR Case effector protein) useful with this invention may be any known or later identified Cas9 nuclease. In some embodiments, a CRISPR Cas9 polypeptide can be a Cas9 polypeptide from, for example, *Streptococcus* spp. (e.g., *S. pyogenes*, *S. thermophilus*), *Lactobacillus* spp., *Bifidobacterium* spp., *Kandleria* spp., *Leuconostoc* spp., *Oenococcus* spp., *Pediococcus* spp., *Weissella* spp., and/or *Olsenella* spp.

Cas12a is a Type V Clustered Regularly Interspaced Short Palindromic Repeats (CRISPR)-Cas effector protein or domain. Cas12a differs in several respects from the more well-known Type II CRISPR Cas9 effector protein. For example, Cas9 recognizes a G-rich protospacer-adjacent motif (PAM) that is 3' to its guide RNA (gRNA, sgRNA) binding site (protospacer, target nucleic acid, target DNA) (3'-NGG), while Cas12a recognizes a T-rich PAM that is located 5' to the target nucleic acid (5'-TTN, 5'-TTTN. In fact, the orientations in which Cas9 and Cas12a bind their guide RNAs are very nearly reversed in relation to their N and C termini. Furthermore, Cas12a effector proteins use a single guide RNA (gRNA, CRISPR array, crRNA) rather than the dual guide RNA (sgRNA (e.g., crRNA and tracrRNA)) found in natural Cas9 systems, and Cas12a processes its own gRNAs. Additionally, nuclease activity of a Cas12a produces staggered DNA double stranded breaks instead of blunt ends produced by nuclease activity of a Cas9, and Cas12a relies on a single RuvC domain to cleave both DNA strands, whereas Cas9 utilizes an HNH domain and a RuvC domain for cleavage.

A CRISPR Cas12a effector protein or domain useful with this invention may be any known or later identified Cas12a nuclease (previously known as Cpf1) (see, e.g., U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided effector protein comprising a Cas12a, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a effector protein or domain having a mutation in its nuclease active site, and therefore, no longer comprising nuclease activity, is commonly referred to as dead or deactivated Cas12a (e.g., dCas12a).

In some embodiments, a Cas12a effector polypeptide that may be optimized or otherwise modified (e.g., deactivate) according to the present invention can include, but is not limited to, the amino acid sequence of any one of SEQ ID NOs:1-20 (e.g., SEQ ID NOs: 1, 2, 3, 4, 5, 6, 7, 8, 9, 10, 11, 12, 13, 14, 15, 16, 17, 18, 19 or 20), or a polynucleotide encoding the same A "guide nucleic acid," "guide RNA," "gRNA," "CRISPR RNA/DNA" "crRNA" or "crDNA" as used herein means a nucleic acid that comprises at least one spacer sequence, which is complementary to (and hybridizes to) a target DNA (e.g., protospacer), and at least one repeat sequence that corresponds to a particular CRISPR-Cas effector protein (e.g., for a Type V CRISPR Cas effector protein, the repeat or a fragment or portion thereof is from a Type V Cas12a CRISPR-Cas system; for a Type II CRISPR Cas effector protein, the repeat or a fragment or portion thereof is from a Type II Cas9 CRISPR-Cas system). Thus, a repeat of a CRISPR-Cas system useful with the present invention may correspond to the CRISPR-Cas effector protein of, for example, Cas9, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5, or a fragment thereof, wherein the repeat sequence may be linked to the 5' end and/or the 3' end of the spacer sequence. The design of a guide nucleic acid of this invention may be based on a Type I, Type II, Type III, Type IV, or Type V CRISPR-Cas system. In some embodiments, the design of a guide nucleic acid of this invention is based on a Type V CRISPR-Cas system.

In some embodiments, a Cas12a guide nucleic acid or extended guide nucleic acid may comprise, from 5' to 3', a repeat sequence (full length or portion thereof ("handle"); e.g., pseudoknot-like structure) and a spacer sequence.

In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat, e.g., repeat-spacer-repeat-spacer-repeat-spacer-repeat-spacer-repeat-spacer, and the like). The guide nucleic acids of this invention are synthetic, human-made and not found in nature. A guide nucleic acid may be quite long and may be used as an aptamer (like in the MS2 recruitment strategy) or other RNA structures hanging off the spacer. In some embodiments, as described herein, a guide nucleic acid may include a template for editing and a primer binding site. In some embodiments, a guide nucleic acid may include a region or sequence on its 5' end or 3' end that is complementary to an editing template (a reverse transcriptase template), thereby recruiting the editing template to the target nucleic acid (i.e., an extended guide nucleic acid). In some embodiments, a guide nucleic acid may include a region or sequence on its 5' end or 3' end that is complementary to a primer on the target nucleic acid (a primer binding site), thereby recruiting the primer binding site to the target nucleic acid (i.e., an extended guide nucleic acid).

A "repeat sequence" as used herein, refers to, for example, any repeat sequence of a wild-type CRISPR Cas locus (e.g., a Cas9 locus, a Cas12a locus, a C2c1 locus, etc.) or a repeat sequence of a synthetic crRNA that is functional with the CRISPR-Cas nuclease encoded by the nucleic acid constructs of the invention. A repeat sequence useful with this invention can be any known or later identified repeat sequence of a CRISPR-Cas locus (e.g., Type I, Type II, Type III, Type IV, Type V or Type VI) or it can be a synthetic repeat designed to function in a Type I, II, III, IV, V or VI CRISPR-Cas system. Thus, in some embodiments, a repeat sequence can be identical to or substantially identical to a repeat sequence from wild-type Type I CRISPR-Cas loci, Type II, CRISPR-Cas loci, Type III, CRISPR-Cas loci, Type IV CRISPR-Cas loci, Type V CRISPR-Cas loci and/or Type VI CRISPR-Cas loci. In some embodiments, a repeat sequence useful with this invention can be any known or later identified repeat sequence of a Type V CRISPR-Cas locus or it can be a synthetic repeat designed to function in a Type V CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical to a repeat sequence from wild type Type V CRISPR-Cas loci or wild type Type II CRISPR-Cas loci. A repeat sequence from a wild-type CRISPR-Cas locus may be determined through established algorithms, such as using the CRISPRfinder offered through CRISPRdb (see, Grissa et al. *Nucleic Acids Res.* 35 (Web Server issue): W52-7 or *BMC Informatics* 8:172 (2007)(doi:10.1186/1471-2105-8-172)). In some embodiments, a repeat sequence or portion thereof is linked at its 3' end to the 5' end of a spacer sequence, thereby forming a repeat-spacer sequence (e.g., guide RNA, crRNA).

In some embodiments, a repeat sequence comprises, consists essentially of, or consists of at least 10 nucleotides depending on the particular repeat and whether the guide RNA comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein; e.g., about). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% identity (e.g., at least about 90%, 91%, 92%, 93%, 94%, 95%, 96%, 97%, 98%, 99%, or more) to the same region (e.g., 5' end) of a wild type CRISPR Cas repeat nucleotide sequence. In some embodiments, a portion of a repeat sequence may comprise a pseudoknot-like structure at its 5' end (e.g., "handle").

A "spacer sequence" as used herein is a nucleotide sequence that is complementary to a target nucleic acid (e.g., target DNA) (e.g., protospacer). The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9% or more)) to a target nucleic acid. Thus, in some embodiments, the spacer sequence can have one, two, three, four, or five mismatches as compared to the target nucleic acid, which mismatches can be contiguous or noncontiguous. In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99%, 99.5%, 99.6%, 99.7%, 99.8%, 99.9% or more complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 23 nucleotides in length.

In some embodiments, the 5' region of a spacer sequence of a guide RNA may be identical to a target DNA, while the 3' region of the spacer may be substantially complementary to the target DNA (e.g., Type V CRISPR-Cas), or the 3' region of a spacer sequence of a guide RNA may be identical to a target DNA, while the 5' region of the spacer may be substantially complementary to the target DNA (e.g., Type II CRISPR-Cas), and therefore, the overall complementarity of the spacer sequence to the target DNA may be less than 100%. Thus, for example, in a guide for a Type V CRISPR-Cas system, the first 1, 2, 3, 4, 5, 6, 7, 8, 9, 10 nucleotides in the 5' region (i.e., seed region) of, for example, a 20 nucleotide spacer sequence may be 100% complementary to the target DNA, while the remaining nucleotides in the 3' region of the spacer sequence are substantially complementary (e.g., at least about 70% complementary) to the target DNA. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9% or more)) to the target DNA.

As a further example, in a guide for a Type II CRISPR-Cas system, the first 1, 2, 3, 4, 5, 6, 7, 8, 9, 10 nucleotides in the 3' region (i.e., seed region) of, for example, a 20 nucleotide spacer sequence may be 100% complementary to the target DNA, while the remaining nucleotides in the 5' region of the spacer sequence are substantially complementary (e.g., at least about 70% complementary) to the target DNA. In some embodiments, the first 1 to 10 nucleotides (e.g., the first 1, 2, 3, 4, 5, 6, 7, 8, 9, 10 nucleotides, and any range therein) of the 3' end of the spacer sequence may be 100% complementary to the target DNA, while the remaining nucleotides in the 5' region of the spacer sequence are substantially complementary (e.g., at least about 50% complementary (e.g., at least about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9% or more or any range or value therein)) to the target DNA.

In some embodiments, a seed region of a spacer may be about 8 to about 10 nucleotides in length, about 5 to about 6 nucleotides in length, or about 6 nucleotides in length.

In some embodiments, an extended guide nucleic acid may be an extended guide nucleic acid, a first extended guide nucleic acid and/or a second extended guide nucleic acid. In some embodiments, an extended guide nucleic acid useful with this invention may comprise: (a) a CRISPR nucleic acid (e.g., CRISPR RNA, CRISPR DNA, crRNA, crDNA) and/or a CRISPR nucleic acid and a tracr nucleic acid; and (b) an extended portion comprising a primer binding site and a reverse transcriptase template (RT template), wherein the RT template encodes a modification to be incorporated into the target nucleic acid. In some embodiments, a CRISPR nucleic acid may be a Type II or Type V CRISPR nucleic acid and/or a tracr nucleic acid may be any tracr corresponding to the appropriate Type II or Type V CRISPR nucleic acid. An extended guide nucleic acid may also be referred to as a targeted allele guide RNA (tagRNA)). In some embodiments, a CRISPR nucleic acid useful with the invention may be a Type V CRISPR nucleic acid. In some embodiments, a tracr nucleic acid useful with the invention may be a Type V CRISPR tracr nucleic acid. In some embodiments, a CRISPR nucleic acid useful with the invention may be a Type II CRISPR nucleic acid. In some embodiments, a tracr nucleic acid useful with the invention may be a Type II CRISPR tracr nucleic acid. In some embodiments, a CRISPR nucleic acid and/or tracr nucleic acid may be from, for example, a Cas9, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5 system.

In some embodiments, an extended portion of the extended guide may comprise, 5' to 3', an RT template and a primer binding site (when the extended guide is linked to the 3' end of the CRISPR nucleic acid). In some embodiments, an extended portion of the extended guide may comprise, 5' to 3', a primer binding site and an RT template (when the extended guide is linked to the 5' end of the CRISPR nucleic acid). In some embodiments, an RT template may be a length of about 1 nucleotide to about 100 nucleotides (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more nucleotides, and any range or value therein), e.g., about 1 nucleotide to about 10 nucleotides, about 1 nucleotide to about 15 nucleotides, about 1 nucleotide to about 20 nucleotides, about 1 nucleotide to about 25 nucleotides, about 1 nucleotide to about 30 nucleotides, about 1 nucleotide to about 35, 36, 37, 38, 39 or 40 nucleotides, about 1 nucleotide to about 50 nucleotides, about 5 nucleotides to about 15 nucleotides, about 5 nucleotides to about 20 nucleotides, about 5 nucleotides to about 25 nucleotides, about 5 nucleotides to about 30 nucleotides, about 5 nucleotides to about 35, 36, 37, 38, 39 or 40 nucleotides, about 5 nucleotides to about 50 nucleotides, about 8 nucleotides to about 15 nucleotides, about 8 nucleotide to about 20 nucleotides, about 8 nucleotide to about 25 nucleotides, about 8 nucleotide to about 30 nucleotides, about 8 nucleotide to about 35, 36, 37, 38, 39 or 40 nucleotides, about 8 nucleotide to about 50 nucleotides in length, about 8 nucleotides to about 100 nucleotides, about 10 nucleotide to about 15 nucleotides, about 10 nucleotide to about 20 nucleotides, about 10 nucleotide to about 25 nucleotides, about 10 nucleotide to about 30 nucleotides, about 10 nucleotide to about 36 nucleotides, about 10 nucleotide to about 40 nucleotides, about 10 nucleotide to about 50 nucleotides, about 10 nucleotides to about 100 nucleotides in length and any range or value therein. In some embodiments, the length of an RT template may be at least 8 nucleotides, optionally about 8 nucleotides to about 100 nucleotides. In some embodiments, the length of an RT template is 36, 37, 38, 39 or 40 nucleotides or less (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length, or any value or range therein (e.g., about 1, 2, 3, 4, 5, 6, 7, 8, 9, 10, 11, 12, 13, 14, or 15 nucleotides in length to about 16, 17, 18, 19, 20, 21, 22, 23, 24, 25, 26, 27, 28, 29, 30, 31, 32, 33, 34, 35, 36, 37, 38, 39, or 40 nucleotides in length.

As used herein, a "primer binding site" (PBS) of an extended portion of an extended guide nucleic acid (e.g., tagRNA) refers to a sequence of consecutive nucleotides that can bind to a region or "primer" on a target nucleic acid, i.e., is complementary to the target nucleic acid primer. As an example, a CRISPR Cas effector protein (e.g., Type II or Type V, e.g., Cas 9 or Cas12a) nicks/cuts the DNA, the 3' end of the cut DNA acts as a primer for the PBS portion of the extended guide nucleic acid. The PBS is designed to be complementary to the 3'end of a strand of the target nucleic acid and can be designed to bind either to the target strand or non-target strand. A primer binding site can be fully complementary to the primer or it may be substantially complementary (e.g., at least 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9% or more)) to the primer on the target nucleic acid. In some embodiments, the length of a primer binding site of an extended portion may be about 1 nucleotide to about 100 nucleotides in length (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more nucleotides, or any value or range therein), about 3, 4, 5, 7, 8, 9, 10, 11, 12, 13, 14, 15, 16, 17, 18, 19, 20, nucleotides to about 50 nucleotides (e.g., about 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 nucleotides, or any range or value therein), or about 25 nucleotides to about 80 nucleotides (e.g., 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides in length, or any range or value therein). In some embodiments, a primer binding site can have a length of about 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides to about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more nucleotides or any range or value therein. In some embodiments, the length of a primer binding site can be at least about 45, 46, 47, 48, 49 or 50 nucleotides or more (e.g., about 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more nucleotides in length or any range or value therein).

In some embodiments, an extended portion of an extended guide may be fused to either the 5' end or 3' end of a Type II or a Type V CRISPR nucleic acid (e.g., 5' to 3': repeat-spacer-extended portion, or extended portion-repeat-spacer) and/or to the 5' or 3' end of the tracr nucleic acid. In some embodiments, when an extended portion is located 5' of the crRNA, the Type V CRISPR-Cas effector protein is modified to reduce (or eliminate) self-processing RNAse activity.

In some embodiments, the extended portion of an extended guide nucleic acid may be linked to the Type II or Type V CRISPR nucleic acid and/or the Type II or Type V tracrRNA via a linker. In some embodiments, a linker may be a length of about 1 to about 100 nucleotides or more (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more nucleotides in length, and any range therein (e.g., about 2 to about 40, about 2 to about 50, about 2 to about 60, about 4 to about 40, about 4 to about 50, about 4 to about 60, about 5 to about 40, about 5 to about 50, about 5 to about 60, about 9 to about 40, about 9 to about 50, about 9 to about 60, about 10 to about 40, about 10 to about 50, about 10 to about 60, about 40 to about 100, about 50 to about 100, or about 2, 3, 4, 5, 6, 7, 8, 9, 10, 11, 12, 13, 14, 15, 16, 17, 18, 19, 20, 21, 22, 23, 24, 25 nucleotides to about 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more nucleotides in length (e.g., about 105, 110, 115, 120, 130, 140 150 or more nucleotides in length).

As used herein, a "target nucleic acid", "target DNA," "target nucleotide sequence," "target region," or a "target region in the genome" refers to a region of an organism's genome that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide RNA of this invention (e.g., the spacer is substantially complementary to the target strand of the target nucleic acid). A target region useful for a CRISPR-Cas system may be located immediately 3' (e.g., Type V CRISPR-Cas system) or immediately 5' (e.g., Type II CRISPR-Cas system) to a PAM sequence in the genome of the organism (e.g., a plant genome). A target region may be selected from any region of at least 15 consecutive nucleotides (e.g., 16, 17, 18, 19, 20, 21, 22, 23, 24, 25, 26, 27, 28, 29, 30 nucleotides, and the like) located immediately adjacent to a PAM sequence on the target strand.

A "protospacer sequence" refers to the target double stranded DNA and specifically to the portion of the target nucleic acid/target DNA (e.g., or target region in the genome (e.g., nuclear genome, plastid genome, mitochondrial genome), or an extragenomic sequence, such as a plasmid, minichromosome, and the like) that is fully or substantially complementary (and hybridizes) to the spacer sequence of the CRISPR repeat-spacer sequences (e.g., guide RNAs, CRISPR arrays, crRNAs). Thus, the protospacer sequences is complementary to the target strand of the target nucleic acid. In some embodiments, a target nucleic acid may have a first strand and a second strand (double stranded DNA). In some embodiments, the term "first strand" as used herein in reference to a target nucleic acid may refer to a target strand or a bottom strand. In some embodiments, the term "second strand" as used in reference to a target nucleic acid is the strand that is complementary to the first strand (e.g., top strand or non-target strand).

As understood in the art and as used herein, a "target strand" refers to the strand of a double stranded DNA to which the spacer is complementary and to which the CRISPR-Cas effector protein is recruited, while the "non-target strand" refers to the strand opposite to the target strand in a double stranded nucleic acid. In some embodiments of the present invention, the non-target strand of a double stranded nucleic acid, the strand opposite of the strand to which the CRISPR-Cas effector protein is recruited, is nicked by the CRISPR-Cas effector protein and is edited by the reverse transcriptase. In some embodiments, the target strand of a double stranded nucleic acid, the same strand to which the CRISPR-Cas effector protein is recruited, is nicked by CRISPR-Cas effector protein and is edited by the reverse transcriptase.

In the case of Type V CRISPR-Cas (e.g., Cas12a) systems and Type II CRISPR-Cas (Cas9) systems, the protospacer sequence is flanked by (e.g., immediately adjacent to) a protospacer adjacent motif (PAM). For Type IV CRISPR-Cas systems, the PAM is located at the 5' end on the non-target strand and at the 3' end of the target strand (see below, as an example).

```
5'-NNNNNNNNNNNNNNNNNNNNN-3'  RNA Spacer (SEQ ID NO: 54)
   |||||||||||||||||||||
3'AAANNNNNNNNNNNNNNNNNNNNN-5' Target strand (SEQ ID NO: 55)
   ||||
5'TTTNNNNNNNNNNNNNNNNNNNNN-3' Non-target strand (SEQ ID NO: 56)
```

In the case of Type II CRISPR-Cas (e.g., Cas9) systems, the PAM is located immediately 3' of the target region. The PAM for Type I CRISPR-Cas systems is located 5' of the target strand. There is no known PAM for Type III CRISPR-Cas systems. Makarova et al. describes the nomenclature for all the classes, types and subtypes of CRISPR systems (*Nature Reviews Microbiology* 13:722-736 (2015)). Guide structures and PAMs are described in by R. Barrangou (*Genome Biol.* 16:247 (2015)).

Canonical Cas12a PAMs are T rich. In some embodiments, a canonical Cas12a PAM sequence may be 5'-TTN, 5'-TTTN, or 5'-TTTV. In some embodiments, canonical Cas9 (e.g., *S. pyogenes*) PAMs may be 5-NGG-3'. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. Appl. *Environ. Microbiol.* 80:994-1001; Mojica et al. 2009. *Microbiology* 155:733-740).

In some embodiments, the present invention further provides a method of modifying a target nucleic acid, the method comprising: contacting the target nucleic acid at a first site with (a)(i) a first CRISPR-Cas effector protein; and (ii) a first extended guide nucleic acid (e.g., first extended CRISPR RNA, first extended CRISPR DNA, first extended crRNA, first extended crDNA); and (b)(i) a second CRISPR-Cas effector protein, (ii) a first reverse transcriptase; and (ii) a first guide nucleic acid, thereby modifying the target nucleic acid. In some embodiments, the method of the invention may further comprise contacting the target nucleic acid with (a) a third CRISPR-Cas effector protein; and (b) a second guide nucleic acid, wherein the third CRISPR-Cas effector protein nicks a site on the first strand of the target nucleic acid that is located about 10 to about 125 base pairs (either 5' or 3') from the second site on the second strand that has been nicked by the second CRISPR-Cas effector protein, thereby improving mismatch repair. In some embodiments, the method of the invention may further comprise contacting the target nucleic acid with: (a) a fourth CRISPR-Cas effector protein; (b) a second reverse transcriptase, and (c) a second extended guide nucleic acid (e.g., second extended CRISPR RNA, second extended CRISPR DNA, second extended crRNA, second extended crDNA), wherein the second extended guide nucleic acid targets (spacer is substantially complementary to/binds to) a site on the first strand of the target nucleic acid, thereby modifying the target nucleic acid. A CRISPR-Cas effector protein (e.g., a first, second, third, fourth) useful with the invention may be any Type I, Type II, Type III, Type IV, or Type V CRISPR-Cas effector protein as described herein, in any combination. In some embodiments, the CRISPR-Cas effector protein may be Cas9, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5.

In some embodiments, an extended guide nucleic acid useful with the first CRISPR-Cas effector protein may comprise (a) a CRISPR nucleic acid (CRISPR RNA, CRISPR DNA, crRNA, crDNA); and (b) an extended portion comprising a primer binding site and a reverse transcriptase template (RT template), wherein the RT template encodes a modification to be incorporated into the target nucleic acid.

In some embodiments, the CRISPR nucleic acid of the extended guide nucleic acid comprises a spacer sequence capable of binding to (having substantial homology to) a first site on the first strand of the target nucleic acid.

In some embodiments, a guide nucleic acid useful with a CRISPR-Cas effector protein comprises a CRISPR nucleic acid (CRISPR RNA, CRISPR DNA, crRNA, crDNA). In some embodiments, the CRISPR nucleic acid of the first guide nucleic acid comprises a spacer sequence that binds to a second site on the first strand of the target nucleic acid that is upstream (3') of the first site on the first strand of the target nucleic acid.

In some embodiments, the second CRISPR-Cas effector protein may be a CRISPR-Cas fusion protein comprising a CRISPR-Cas effector protein domain fused to the reverse transcriptase.

In some embodiments, the second CRISPR-Cas effector protein may be a CRISPR-Cas fusion protein comprising a CRISPR-Cas effector protein domain fused to a peptide tag and the reverse transcriptase may be a reverse transcriptase fusion protein comprising a reverse transcriptase domain that is fused to an affinity polypeptide capable of binding the peptide tag.

In some embodiments, the first guide nucleic acid may be linked to an RNA recruiting motif and the reverse transcriptase may be a reverse transcriptase fusion protein comprising a reverse transcriptase domain that is fused to an affinity polypeptide capable of binding the RNA recruiting motif.

In some embodiments, the target nucleic acid may further be contacted with a 5'-3' exonuclease, optionally wherein the 5'-3' exonuclease is fused to the first CRISPR-Cas effector protein. In some embodiments, a 5'-3' exonuclease may be a fusion protein comprising a 5'-3' exonuclease fused to a peptide tag and the first CRISPR-Cas effector protein may be a fusion protein comprising a CRISPR-Cas effector protein domain fused to an affinity polypeptide that is capable of binding to the peptide tag. In some embodiments, a 5'-3' exonuclease may be a fusion protein comprising a 5'-3' exonuclease fused to an affinity polypeptide that is capable of binding to the peptide tag and the first CRISPR-Cas effector protein may be a fusion protein comprising a CRISPR-Cas effector protein domain fused to a peptide tag. In some embodiments, a 5'-3' exonuclease may be a fusion protein comprising a 5'-3' exonuclease that is fused to an affinity polypeptide that is capable of binding to an RNA recruiting motif and the extended guide nucleic acid is linked to an RNA recruiting motif.

In some embodiments, the methods of the invention may further comprise reducing double strand breaks by introducing a chemical inhibitor of non-homologous end joining (NHEJ), by introducing a CRISPR guide nucleic acid or an siRNA targeting an NHEJ protein to transiently knock-down expression of the NHEJ protein, or by introducing a polypeptide that prevents NHEJ (e.g., a Gam protein).

In some embodiments, a complex is provided, the complex comprising: (a) a Type II CRISPR-Cas effector protein or a Type V CRISPR-Cas effector protein; (b) a reverse transcriptase, and (c) an extended guide nucleic acid (e.g., extended CRISPR RNA, extended CRISPR DNA, extended crRNA, extended crDNA; e.g., a tagDNA, tagRNA).

In some embodiments, the Type II or Type V CRISPR-Cas effector protein of a complex may be a fusion protein comprising a Type II or Type V CRISPR-Cas effector protein domain fused to a peptide tag. In some embodiments, the Type II or Type V CRISPR-Cas effector protein of the complex may be a fusion protein comprising a Type II or Type V CRISPR-Cas effector protein domain fused to an affinity polypeptide that is capable of binding a peptide tag. In some embodiments, the Type II or Type V CRISPR-Cas effector protein of the complex may be a fusion protein comprising a Type II or Type V CRISPR-Cas effector protein domain fused to an affinity polypeptide that is capable of binding an RNA recruiting motif.

In some embodiments, the reverse transcriptase of the complex may be a fusion protein comprising a reverse transcriptase domain fused to a peptide tag. In some embodiments, the reverse transcriptase of the complex may be a fusion protein comprising reverse transcriptase domain fused to an affinity polypeptide that is capable of binding a peptide tag. In some embodiments, the reverse transcriptase of the complex may be a fusion protein comprising reverse transcriptase domain fused to an affinity polypeptide that is capable of binding an RNA recruiting polypeptide. In some embodiments, the complex may further comprise a guide nucleic acid (e.g., extended CRISPR RNA, extended CRISPR DNA, extended crRNA, extended crDNA). In some embodiments, the complex may further comprise an extended guide nucleic acid (e.g., extended CRISPR RNA, extended CRISPR DNA, extended crRNA, extended crDNA).

In some embodiments, a complex of the invention may be comprised in an expression cassette, optionally wherein the expression cassette is comprised in a vector.

The present invention further provides an expression cassette codon optimized for expression in an organism, comprising 5' to 3' (a) polynucleotide encoding a promoter sequence, (b) a polynucleotide encoding a Type V CRISPR-Cas nuclease (e.g., Cpf1 (Cas12a), dCas12a and the like) or a Type II CRISPR-Cas nuclease (e.g., Cas9, dCas9 and the like) that is codon optimized for expression in the organism; (c) a linker sequence; and (d) a polynucleotide encoding a reverse transcriptase that is codon-optimized for expression in the organism, optionally wherein the organism is wherein the organism is an animal such as a human, a plant, a fungus, an archaeon, or a bacterium. Further provided is an expression cassette codon optimized for expression in a plant, comprising 5' to 3' (a) polynucleotide encoding a plant specific promoter sequence (e.g. ZmUbi1, MtUb2, RNA polymerase II (Pol II)), (b) a plant codon-optimized polynucleotide encoding a Type V CRISPR-Cas nuclease (e.g., Cpf1 (Cas12a), dCas12a and the like); (c) a linker sequence; and (d) a plant codon-optimized polynucleotide encoding a reverse transcriptase. In some embodiments, the reverse transcriptase comprised in the expression cassette may be fused to one or more ssRNA binding domains (RBDs). In some embodiments, a linker sequence may be an amino acid or peptide linker as described herein.

The present invention further provides an expression cassette codon optimized for expression in a plant, comprising (a) a polynucleotide encoding a plant specific promoter sequence (e.g. ZmUbi1, MtUb2), and (b) an extended RNA guide sequence, wherein the extended guide nucleic acid comprises an extended portion comprising at its 3' end a primer binding site and an edit to be incorporated into the target nucleic acid (e.g., reverse transcriptase template), optionally wherein the extended guide nucleic acid is comprised in an expression cassette, optionally wherein the extended guide nucleic acid is operably linked to a Pol II promoter.

In some embodiments, a plant specific promoter useful with an expression cassette of the invention may be associated with an intron or is a promoter region comprising an intron (e.g., ZmUbi1 comprising an intron; MtUb2 comprising an intron).

In some embodiments, the expression cassette may be codon optimized for expression in a dicot plant. In some embodiments, the expression cassette may be codon optimized for expression in a monocot plant.

In some embodiments, the present invention provides methods for modifying a target nucleic acid in a plant or plant cell, comprising introducing one or more expression cassettes of the invention into the plant or plant cell, thereby modifying the target nucleic acid in the plant or plant cell to produce a plant or plant cell comprising the modified target nucleic acid. In some embodiments, the methods of the invention further comprise regenerating a plant from the plant cell comprising the modified target nucleic acid to produce a plant comprising the modified target nucleic acid. In some embodiments, the methods of the invention comprise contacting the target nucleic acid at a temperature of about 20° C. to 42° C. (e.g., about 20, 21, 22, 23, 24, 25, 26, 27, 28, 29, 30, 31, 32, 33, 34, 35, 36, 37, 38, 39, 40, 41, or 42° C., and any value or range therein.

In some embodiments, the invention provides cells comprising one or more polynucleotides, guide nucleic acids, nucleic acid constructs, expression cassettes or vectors of the invention.

When used in combination with guide nucleic acids, the polynucleotides/nucleic acid constructs/expression cassettes of the invention of the invention may be used to modify a target nucleic acid. A target nucleic acid may be contacted with a polynucleotide/nucleic acid construct/expression cassette of the invention prior to, concurrently with or after contacting the target nucleic acid with the guide nucleic acid. In some embodiments, the polynucleotides of the invention and a guide nucleic acid may be comprised in the same expression cassette or vector and therefore, a target nucleic acid may be contacted concurrently with the polynucleotides of the invention and guide nucleic acid. In some embodiments, the polynucleotides of the invention and a guide nucleic acid may be in different expression cassettes or vectors and thus, a target nucleic acid may be contacted with the polynucleotides of the invention prior to, concurrently with, or after contact with a guide nucleic acid.

A target nucleic acid of any organism may be modified (e.g., mutated, e.g., base edited, cleaved, nicked, etc.) using the polynucleotides of the invention, including but not limited to a plant, an animal, a bacterium, an archaeon, and/or a fungus. Any animal or cell there of may be modified (e.g., mutated, e.g., base edited, cleaved, nicked, etc.) using the polynucleotides of the invention including, but not limited to an insect, a fish, a bird, an amphibian, a reptile, and/or a mammal. Exemplary mammals for which this invention may be useful include, but are not limited to, primates (human and non-human (e.g., a chimpanzee, baboon, monkey, gorilla, etc.)), cats, dogs, ferrets, gerbils, hamsters, cows, pigs, horses, goats, donkeys, or sheep.

A target nucleic acid of any plant or plant part may be modified (e.g., mutated, e.g., base edited, cleaved, nicked, etc.) using the polynucleotides of the invention. Any plant (or groupings of plants, for example, into a genus or higher order classification) may be modified using the nucleic acid constructs of this invention including an angiosperm, a gymnosperm, a monocot, a dicot, a C3, C4, CAM plant, a bryophyte, a fern and/or fern ally, a microalgae, and/or a macroalgae. A plant and/or plant part useful with this invention may be a plant and/or plant part of any plant species/variety/cultivar. The term "plant part," as used herein, includes but is not limited to, embryos, pollen, ovules, seeds, leaves, stems, shoots, flowers, branches, fruit, kernels, ears, cobs, husks, stalks, roots, root tips, anthers, plant cells including plant cells that are intact in plants and/or parts of plants, plant protoplasts, plant tissues, plant cell tissue cultures, plant calli, plant clumps, and the like. As used herein, "shoot" refers to the above ground parts including the leaves and stems. Further, as used herein, "plant cell" refers to a structural and physiological unit of the plant, which comprises a cell wall and also may refer to a protoplast. A plant cell can be in the form of an isolated single cell or can be a cultured cell or can be a part of a higher-organized unit such as, for example, a plant tissue or a plant organ.

Non-limiting examples of plants useful with the present invention include turf grasses (e.g., bluegrass, bentgrass, ryegrass, fescue), feather reed grass, tufted hair grass, miscanthus, arundo, switchgrass, vegetable crops, including artichokes, kohlrabi, arugula, leeks, asparagus, lettuce (e.g., head, leaf, romaine), malanga, melons (e.g., muskmelon, watermelon, crenshaw, honeydew, cantaloupe), cole crops (e.g., brussels sprouts, cabbage, cauliflower, broccoli, collards, kale, Chinese cabbage, bok choy), cardoni, carrots, napa, okra, onions, celery, parsley, chick peas, parsnips, chicory, peppers, potatoes, cucurbits (e.g., marrow, cucumber, zucchini, squash, pumpkin, honeydew melon, watermelon, cantaloupe), radishes, dry bulb onions, rutabaga, eggplant, salsify, escarole, shallots, endive, garlic, spinach, green onions, squash, greens, beet (sugar beet and fodder beet), sweet potatoes, chard, horseradish, tomatoes, turnips, and spices; a fruit crop such as apples, apricots, cherries, nectarines, peaches, pears, plums, prunes, cherry, quince, fig, nuts (e.g., chestnuts, pecans, pistachios, hazelnuts, pistachios, peanuts, walnuts, macadamia nuts, almonds, and the like), citrus (e.g., clementine, kumquat, orange, grapefruit, tangerine, mandarin, lemon, lime, and the like), blueberries, black raspberries, boysenberries, cranberries, currants, gooseberries, loganberries, raspberries, strawberries, blackberries, grapes (wine and table), avocados, bananas, kiwi, persimmons, pomegranate, pineapple, tropical fruits, pomes, melon, mango, papaya, and lychee, a field crop plant such as clover, alfalfa, timothy, evening primrose, meadow foam, corn/maize (field, sweet, popcorn), hops, jojoba, buckwheat, safflower, quinoa, wheat, rice, barley, rye, millet, sorghum, oats, triticale, sorghum, tobacco, kapok, a leguminous plant (beans (e.g., green and dried), lentils, peas, soybeans), an oil plant (rape, canola, mustard, poppy, olive, sunflower, coconut, castor oil plant, cocoa bean, groundnut, oil palm), duckweed, *Arabidopsis*, a fiber plant (cotton, flax, hemp, jute), *Cannabis* (e.g., *Cannabis sativa*, *Cannabis indica*, and *Cannabis ruderalis*), lauraceae (cinnamon, camphor), or a plant such as coffee, sugar cane, tea, and natural rubber plants; and/or a bedding plant such as a flowering plant, a cactus, a succulent and/or an ornamental plant (e.g., roses, tulips, violets), as well as trees such as forest trees (broad-leaved trees and evergreens, such as conifers; e.g., elm, ash, oak, maple, fir, spruce, cedar, pine, birch, cypress, eucalyptus, willow), as well as shrubs and other nursery stock. In some embodiments, the nucleic acid constructs of the invention and/or expression cassettes and/or vectors encoding the same may be used to modify maize, soybean, wheat, canola, rice, tomato, pepper, sunflower, raspberry, blackberry, black raspberry and/or cherry.

The present invention further comprises a kit or kits to carry out the methods of this invention. A kit of this invention can comprise reagents, buffers, and apparatus for mixing, measuring, sorting, labeling, etc, as well as instructions and the like as would be appropriate for modifying a target nucleic acid.

In some embodiments, the invention provides a kit comprising one or more nucleic acid constructs of the invention and/or expression cassettes and/or vectors comprising the same, with optional instructions for the use thereof. In some embodiments, a kit may further comprise a CRISPR-Cas guide nucleic acid (or extended guide nucleic acid) (corresponding to the CRISPR-Cas effector protein encoded by the polynucleotide of the invention) and/or expression cassette and/or vector comprising the same. In some embodiments, the guide nucleic acid/extended guide nucleic acid may be provided on the same expression cassette and/or vector as one or more polynucleotides of the invention. In some embodiments, a guide nucleic acid/extended guide nucleic acid may be provided on a separate expression cassette or vector from that comprising one or more of the polynucleotides of the invention.

In some embodiments, the kit may further comprise a nucleic acid construct encoding a guide nucleic acid, wherein the construct comprises a cloning site for cloning of a nucleic acid sequence identical or complementary to a target nucleic acid sequence into backbone of the guide nucleic acid.

In some embodiments, a nucleic acid construct of the invention may be an mRNA that may encode one or more introns within the encoded polynucleotide. In some embodiments, an expression cassette and/or vector comprising one or more polynucleotides of the invention, may further encode one or more selectable markers useful for identifying transformants (e.g., a nucleic acid encoding an antibiotic resistance gene, herbicide resistance gene, and the like).

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

RNA-encoded DNA-replacement of alleles (REDRAW) utilizes a type V Cas effector, an enzyme which polymerizes from a DNA:RNA hybrid from a free DNA 3' end (annealing site, AS), and an extended guide nucleic acid (i.e., a targeted allele guide RNA (tagRNA)). These three macromolecules work in tandem to i) locate the CRISPR enzyme to the genomic site of interest using a CRISPR effector and the crRNA portion of the tagRNA, ii) nick or cut the DNA to produce a free 3' end, iii) provide a portion of the tagRNA which anneals to the free 3' end of the DNA, iv) provide a portion of tagRNA which provides a template for the RNA-dependent DNA polymerase, and v) allow the termination of reverse transcription either by enzyme collision, natural termination, or encountering a stable hairpin.

We tested the REDRAW system using a nontarget-stand (NTS) nickase version of LbCas12a_R1138A and a RT from Moloney Murine Leukemia Virus (M-MuLV). LbCas12a_R1138A was expected to be an NTS nickase based on alignment with an the previously described AsCas12a_R1226A mutation. We demonstrate in FIG. 4 that LbCas12a_R1138A is, indeed, a nickase. The LbCas12a used was either RNAse (+) or had a mutation which prevented RNAse activity (H759A). The LbCas12a_R1138A_H759A mutant was used to prevent self-processing of the tagRNA when making 5' extension or when incorporating a 3' hairpin.

The tagRNAs tested contained crRNAs containing either 5' or 3' extensions. Various annealing sitelengths were tested allowing for shorter or longer DNA:RNA hybrids to form from at the nicked non-target strand. Various lengths of RNA template were tested as well. Finally, two different hairpins were also incorporated into a naturally-occurring LbCas12a pseudoknotted hairpin design and a decoy pseudoknotted hairpin design.

Example 1

LbCas12a_R1138A Nickase Assay

A nucleic acid construct was synthesized comprising LbCas12a, followed by a nucleoplasmin NLS, and a 6× histidine tag (GeneWiz) (SEQ ID NO:57) and cloned into a pET28a vector between NcoI and XhoI, generating pWISE450 (SEQ ID NO:58). There was an additional glycine added to the sequence between Met-1 and Ser-2 to facilitate cloning. Numbering presented herein excludes this extra glycine. Then the R1138A mutation was made using a QuickChange II site-directed mutagenesis kit (Agilent) according to manufacturer's instructions. These expression plasmids were then transformed into BL21 (DE3) Star competent *E. coli* cells (ThermoFisher Scientific).

The BL21(DE3) Star cells were grown in Luria Broth and 50 ug/ml of kanamycin at 37° C. until an optical density of A600=0.5 was achieved. Isopropyl β-d-1-thiogalactopyranoside (IPTG) was added to 0.5 mM and protein was induced overnight at 18° C. Cells were pelleted at 5,000×g. Purification was accomplished using two columns: a His-Trap column followed by a MonoS column (GE Healthcare) according to manufacturer's protocols.

CRISPR RNA (crRNA) was synthesized by Synthego with the sequence AAUUUCUACUAAGUGUAGAUG-GAAUCCCUUCUGCAGCACCUGG (SEQ ID NO:59) (where the guide portion is in bold font).

The plasmid to be cleaved was pUC19 with the following sequence inserted: TTTCG-GAATCCCTTCTGCAGCACCTGG (SEQ ID NO:60) where the portion of the sequence in bold font is a PAM sequence recognized by LbCas12a and the remainder (regular font) is the protospacer sequence. The pUC19 plasmid was transformed into XLI-Blue (Agilent) (*E. coli*), and subsequently purified using Qiagen plasmid spin minikits.

Figure 4:
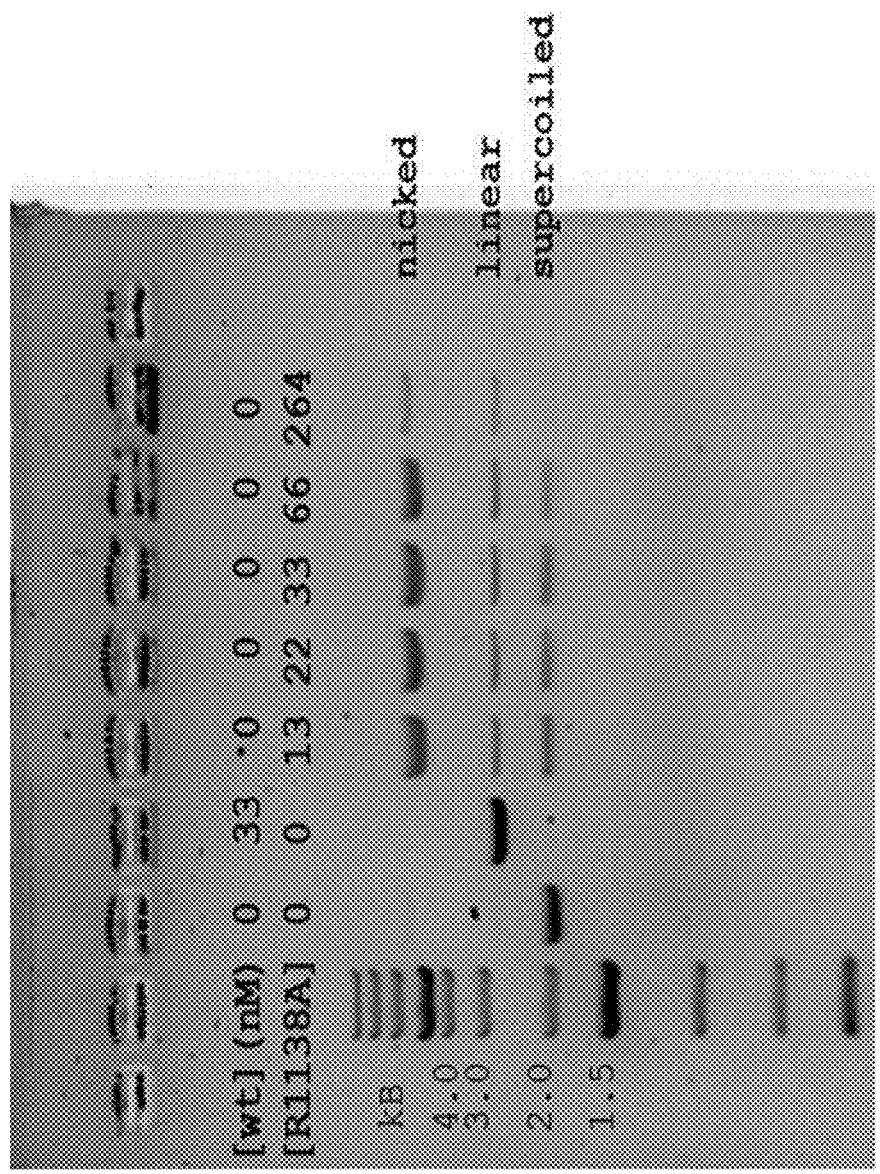
FIG. 4. LbCas12a_R1138A is a nickase as demonstrated in vitro, resolved on a 1% TAE-agarose gel. A supercoiled 2.8 kB plasmid ran with an apparent size of 2.0 kB (lane 2) until a double-stranded break was generated by wildtype LbCas12a (lane 3).

The nuclease assay was accomplished by mixing 10:10:1 ratios of LbCas12a_R1138:crRNA:plasmid, incubated for 15 minutes at 37° C. in New England Biolabs buffer 2.1, heat inactivated for 20 minutes at 80° C., and loaded onto a 1% TAE-agarose gel with SYBR-Safe stain (Invitrogen) embedded to stain the DNA. As shown in FIG. 4 in an in vitro assay, LbCas12a_R1138A is a nickase. As shown in lanes 2 and 3, a supercoiled 2.8 kB plasmid ran with an apparent size of 2.0 kB (lane 2) until a double-stranded break was generated by wildtype LbCas12a (lane 3). The mutant enzyme LbCas12a_R1138A predominantly generated a nicked product running with the apparent size of 5.0 kB. Lanes 4-6 show that increasing concentrations of the mutant enzyme did not alter the ratio until extremely high concentrations of enzyme were used resulting in general nuclease digestion of the plasmid (256 nM).

REDRAW Editor Plasmid Design and Construction—Bacterial Screen

Figure 5:
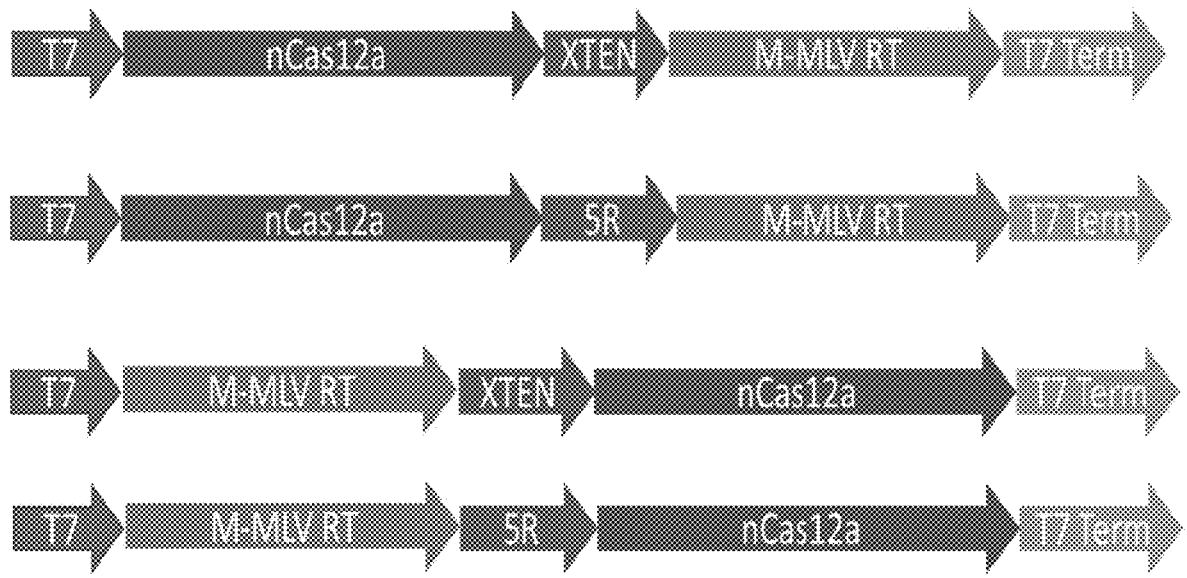
FIG. 5 shows configurations of REDRAW editors tested in E. coli (see Example 1).

REDRAW (RNA-encoded DNA-replacement of alleles) expression constructs were synthesized by solid state synthesis and cloned into expression vector pET28a(+) in between the NcoI and XhoI restriction sites. The REDRAW expression vectors contain a ColE1 origin of replication, a kanamycin resistance marker, and a REDRAW editor under control of a T7 promoter and terminator. The REDRAW editors contain either a Cas12a nickase (R1138A) or an Rnase dead Cas12a nickase (R1138A, H759A) fused to Mu-LV reverse transcriptase MuLV(5M) (see, e.g., SEQ ID NO:97) (Murine leukemia virus reverse transcriptase with five mutations—D200N+L603W+T330P+T306K+W313F) (Anzalone et al. *Nature* 576 (0.7785):149-157 (2019)) with an XTEN or 5R linker. All REDRAW editor sequences were *E. coli* codon optimized. The REDRAW editor configurations tested are shown in FIG. 5. Two configurations provided in FIG. 5 had Cas12a N-terminal to the reverse transcriptase, and two configurations had Cas12a C-terminal to the reverse transcriptase. The tested configurations were built with a Cas12a variant that had an additional H759A mutation to prevent processing of tagRNAs that contain a 5' extension.

tagRNA Plasmid Design and Construction-Bacterial Screen

The sequences of the tagRNA (targeted allele guide RNA) library were designed using an algorithm that assembled a Cas12a spacer and scaffold sequence together with a reverse transcriptase template and primer binding site unique for each target. The design parameters, shown in Table 1, span a wide range of primer binding site and reverse transcriptase template lengths. The desired changes, shown in Table 3, were designed to confer resistance to antibiotics following successful editing.

TABLE 1

Conformations of tagRNAs tested in the first library

| Type | PBS | RTT | Targets in Library |
|---|---|---|---|
| 5' extension | 10-20 nt, 1 nt steps | 10-150 nt, 5 nt steps | 2 genomic, 3 plasmid |
| 3' extension | 10-20 nt, 1 nt steps | 10-150 nt, 5 nt steps | 2 genomic, 3 plasmid |

Figure 6:
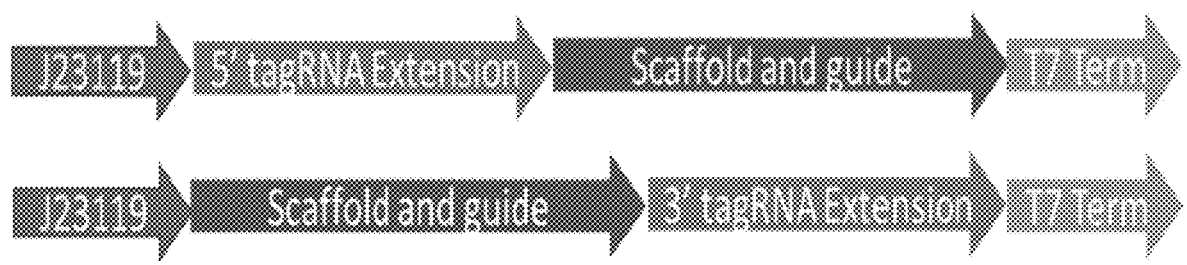
FIG. 6 shows conformations of tagRNAs tested in the first library.

FIG. 6 shows the configurations of the tagRNAs in the first library. Both 5' and 3' extensions containing the RTT and PBS were included in the library.

Figure 7:
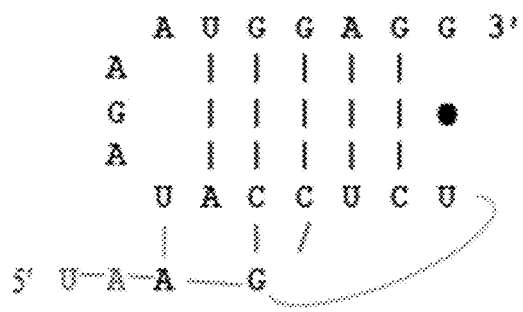
FIG. 7 shows the structure of an example designed hairpin sequence for use in REDRAW editing.

A second library was designed in a similar fashion as the first, while additionally evaluating whether the presence of a hairpin, located just 3' of the spacer in the 3' tagRNA extension configuration, would improve REDRAW editing. The design parameters, shown in Table 2, again interrogate a wide range of primer binding site (PBS) and reverse transcriptase template (RTT) lengths, but also focus on the region of RTT length found to be functional from the first library. Both 5' and 3' extensions containing the RTT and PBS were included in the library. Additionally, variants containing a decoy hairpin were also included in the second tagRNA library. As a hairpin was desired that would be similar to the natural LbCas12a scaffold sequence, but would not be recognized and cleaved by the Cas12a protein, an existing hairpin with similar architecture to the LbCas12a hairpin was found in the HIV-1 RNA genome and modified by the addition of a UA sequence to form a pseudoknot, as shown in FIG. 7.

TABLE 2

Conformations of tagRNAs tested in the second library

| TagRNA Extension | Range of PBS | Range of RTT | Decoy Hairpin | Targets |
|---|---|---|---|---|
| 5' end | 10-20 nt, 1-nt steps | 10-190 nt, 5-nt steps | None | 2 genomic, 3 plasmid |
| 3/end | 10-20 nt, 1-nt steps | 10-190 nt, 5-nt steps; 65-85 nt, 2-nt steps | With and without | 2 genomic, 3 plasmid | tagRNA Plasmid Construction for Bacterial Screen

The base plasmid for the tagRNA library was generated by solid state synthesis and cloning of a holder fragment into pTwist Amp Medium Copy (TWIST BIOSCIENCE©). The plasmid contains a p15A origin of replication and an ampicillin resistance marker. The tagRNAs are constitutively expressed from a synthetic BbaJ23119 promoter and are terminated by a T7 terminator. The first tagRNA library evaluated was synthesized and cloned into the tagRNA base vector by an external vendor (Genewiz). For the second library, oligos were synthesized and then cloned into the tagRNA base vector using an NEB HiFi Assembly kit according to manufacturer's instructions. Library diversity was investigated by colony PCR and Sanger sequencing of 72 clones from the library, to ensure that a wide range of PBS, RTT, and targets were included in the library and that there was not a substantial bias.

Reporter Plasmid Design and Construction

A base reporter plasmid containing a CloDF13 origin of replication, chloramphenicol resistance marker, and spectinomycin resistance marker (aadA) was constructed by PCR amplification of the CloDF13 origin of replication and chloramphenicol resistance marker and ligating it with a PCR-amplified aadA resistance marker. Three reporter plasmids containing variants of aadA were then constructed by cutting out the wild-type aadA gene in between the BamHI and BglII restriction sites and ligating in gene blocks synthesized that contained a stop codon at residue position Thr61, Leu115, or Asp132. All reporter plasmids were verified by Sanger sequencing after construction. In addition, reporter plasmids containing an aadA variant with a stop codon in the coding sequence were verified as both spectinomycin and streptomycin sensitive prior to using them in REDRAW tagRNA screening experiments.

Targets for REDRAW Editing—Bacterial Screen

Five targets were tested in the REDRAW editing experiments, shown below in Table 3. Two genomic and three plasmid targets were used in all cases. Successful REDRAW editing at any of the targets results in resistance to an antibiotic (nalidixic acid or streptomycin), tying survival of the host organism (E. coli) to the success of REDRAW editing.

TABLE 3

Targets for bacterial REDRAW editing

| Target | Location of Target | Desired Edit | Successful Editing Result |
|---|---|---|---|
| gyrA | Genome | Ser83 > Leu TCG > TTG | Resistance to Nalidixic Acid |
| rpsL | Genome | Lys44 > Arg AAA > CGT | Resistance to Streptomycin |
| aadA | Plasmid | Stop61 > Thr TGA > ACG | Resistance to Streptomycin |
| aadA | Plasmid | Stop115 > Leu TGA > CTG | Resistance to Streptomycin |
| aadA | Plasmid | Stop132 > Asp TGA > GAT | Resistance to Streptomycin |

REDRAW tagRNA Experiments—Bacterial Screen

The host organism for all bacterial REDRAW tagRNA screening experiments was E. coli BL21(DE3). Prior to performing the selection experiments, each REDRAW expression construct was transformed into chemically competent BL21(DE3) according to manufacturer's instructions and plated onto LB agar plates with Kanamycin. Single colonies were then picked from the transformation plates, and batches of electrocompetent cells were made following a previously developed method (Sambrook and Russell (Transformation of E. coli by electroporation. Cold Spring Harbor Protocols 2006.1 (2006): pdb-prot3933). Competent cells harboring each REDRAW expression construct were then electroporated with 10 ng of each reporter plasmid, recovered for 1 hour in SOC at 37C, 225 rpm, and plated onto LB agar plates with kanamycin and chloramphenicol. Single colonies from these plates were then picked from the transformation plates, and batches of electrocompetent cells were made again (Sambrook and Russell (Transformation of E. coli by electroporation. Cold Spring Harbor Protocols 2006.1 (2006): pdb-prot3933). Table 4 below summarizes the batches of electrocompetent cells made for the first tagRNA library testing.

TABLE 1

Electrocompetent Cells prepared for tagRNA Library 1 Selection Experiments

| Competent Cell Batch | Constructs Harbored in BL21(DE3) | SEQ ID NO |
|---|---|---|
| 1 | SV40-MMLV-RT-XTEN-nRRLbCas12a-SV40 | 63 |
| 2 | SV40-MMLV-RT-5R-nRRLbCas12a-SV40 | 64 |
| 3 | SV40-nRRLbCas12a-XTEN-MMLV-RT-SV40 | 65 |
| 4 | SV40-nRRLbCas12a-5R-MMLV-RT-SV40 | 66 |
| 5 | SV40-MMLV-RT-XTEN-nRVRLbCas12a-SV40 | 67 |
| 6 | SV40-MMLV-RT-5R-nRVRLbCas12a-SV40 | 68 |
| 7 | SV40-nRVRLbCas12a-XTEN-MMLV-RT-SV40 | 69 |
| 8 | SV40-nRVRLbCas12a-5R-MMLV-RT-SV40 | 70 |
| 9 | SV40-MMLV-RT-XTEN-nLbCas12a-SV40 + aadA Thr61 | 71 + Thr61 |
| 10 | SV40-MMLV-RT-XTEN-nLbCas12a-SV40 + aadA Leu115 | 71 + Leu115 |
| 11 | SV40-MMLV-RT-XTEN-nLbCas12a-SV40 + Asp132 | 71 + Asp132 |
| 12 | SV40-MMLV-RT-5R-nLbCas12a-SV40 + Thr61 | 72 + Thr61 |
| 13 | SV40-MMLV-RT-5R-nLbCas12a-SV40 + Leu115 | 72 + Leu115 |
| 14 | SV40-MMLV-RT-5R-nLbCas12a-SV40 + Asp132 | 72 + Asp132 |
| 15 | SV40-nLbCas12a-XTEN-MMLV-RT-SV40 + Thr61 | 73 + Thr61 |
| 16 | SV40-nLbCas12a-XTEN-MMLV-RT-SV40 + Leu115 | 73 + Leu115 |
| 17 | SV40-nLbCas12a-XTEN-MMLV-RT-SV40 + Asp132 | 73 + Asp132 |
| 18 | SV40-nLbCas12a-5R-MMLV-RT-SV40 + Thr61 | 74 + Thr61 |
| 19 | SV40-nLbCas12a-5R-MMLV-RT-SV40 + Leu115 | 74 + Leu115 |
| 20 | SV40-nLbCas12a-5R-MMLV-RT-SV40 + Asp132 | 74 + Asp132 |

SV40 = NLS,
MMLV-RT = reverse transcriptase,
XTEN = linker,
nLbCas12a = nickase Cas12

Selection experiments were performed by first electroporating 100 ng of tagRNA library into 50 uL of each batch of electrocompetent cells. Transformations were recovered for 1 hour at 37° C. with 225 rpm shaking. After 1 hour of recovery, 1 uL of recovery was removed, mixed with 99 uL of LB, and plated onto LB agar plates with appropriate antibiotics to check for transformation efficiency. The remaining amount of each transformation was then added to 29 mL of LB+Antibiotics (LB Kan/Carb for genomic selections, and LB Kan/Carb/Cam for plasmid selections) and 0.5 mM IPTG. The expression cultures were grown at 37° C., with 225 rpm shaking overnight.

The following day, the OD600 of each expression culture was measured. For each expression culture, 1 OD was plated onto 5 plates (about 0.2 OD per plate) containing antibiotics for the REDRAW expression vector (Kan), the tagRNA plasmid (Carb), the reporter plasmid, 0.5 mM IPTG, and an additional selection antibiotic (nalidixic acid or streptomycin). Plates were incubated overnight at 37° C., and growth was observed the following morning. If no colonies were observed, the plates were incubated an additional 24 hours at 37° C.

Colonies that were observed on the selection plates were picked, re-streaked onto plates with appropriate antibiotics, and then subjected to colony PCR to amplify the gene targeting for editing and the tagRNA for Sanger sequencing. Sanger sequencing was performed on the colony PCR products by Genewiz.

Evaluation of the second library was performed the same way as the first tagRNA library, with one modification. Instead of preparing 20 batches of electrocompetent cells, one large batch of electrocompetent BL21(DE3) harboring the second tagRNA library was prepared. The REDRAW expression constructs (100 ng) or the REDRAW expression constructs+reporter plasmids (100 ng each) were then transformed into electrocompetent cells harboring the tagRNA library. All subsequent steps were repeated in the same manner.

Evaluation of REDRAW Editing with the First tagRNA Library-Bacterial Screen

The number of colonies obtained from the selection experiments for the first tagRNA library are summarized in Table 5 below. No colonies were observed for either of the genomic selections (selections 1-8). For each of the plasmid selections, colonies were observed.

TABLE 5

First tagRNA library selection experiment results.

| Selection Number | REDRAW Editor | Target | Colonies on Selection Plates |
|---|---|---|---|
| 1 | SV40-MMLV-RT-XTEN-nRRLbCas12a-SV40 (SEQ ID NO: 63) | gyrA (genome) | 0 |
| 2 | SV40-MMLV-RT-5R-nRRLbCas12a-SV40 (SEQ ID NO: 64) | gyrA (genome) | 0 |
| 3 | SV40-nRRLbCas12a-XTEN-MMLV-RT-SV40 (SEQ ID NO: 65) | gyrA (genome) | 0 |
| 4 | SV40-nRRLbCas12a-5R-MMLV-RT-SV40 (SEQ ID NO: 66) | gyrA (genome) | 0 |
| 5 | SV40-MMLV-RT-XTEN-nRVRLbCas12a-SV40 (SEQ ID NO: 67) | rpsL (genome) | 0 |

TABLE 5-continued

First tagRNA library selection experiment results.

| Selection Number | REDRAW Editor | Target | Colonies on Selection Plates |
|---|---|---|---|
| 6 | SV40-MMLV-RT-5R-nRVRLbCas12a-SV40 (SEQ ID NO: 68) | rpsL (genome) | 0 |
| 7 | SV40-nRVRLbCas12a-XTEN-MMLV-RT-SV40 (SEQ ID NO: 69) | rpsL (genome) | 0 |
| 8 | SV40-nRVRLbCas12a-5R-MMLV-RT-SV40 (SEQ ID NO: 70) | rpsL (genome) | 0 |
| 9 | SV40-MMLV-RT-XTEN-nLbCas12a-SV40 (SEQ ID NO: 71) | aadA Thr61 (plasmid) | Lawn |
| 10 | SV40-MMLV-RT-XTEN-nLbCas12a-SV40 (SEQ ID NO: 71) | aadA Leu115 (plasmid) | 11 |
| 11 | SV40-MMLV-RT-XTEN-nLbCas12a-SV40 (SEQ ID NO: 71) | aadA Asp132 (plasmid) | 9 |
| 12 | SV40-MMLV-RT-5R-nLbCas12a-SV40 (SEQ ID NO: 72) | aadA Thr61 (plasmid) | Lawn |
| 13 | SV40-MMLV-RT-5R-nLbCas12a-SV40 (SEQ ID NO: 72) | aadA Leu115 (plasmid) | 10 |
| 14 | SV40-MMLV-RT-5R-nLbCas12a-SV40 (SEQ ID NO: 72) | aadA Asp132 (plasmid) | 9 |
| 15 | SV40-nLbCas12a-XTEN-MMLV-RT-SV40 (SEQ ID NO: 73) | aadA Thr61 (plasmid) | Lawn |
| 16 | SV40-nLbCas12a-XTEN-MMLV-RT-SV40 (SEQ ID NO: 73) | aadA Leu115 (plasmid) | 1 |
| 17 | SV40-nLbCas12a-XTEN-MMLV-RT-SV40 (SEQ ID NO: 73) | aadA Asp132 (plasmid) | 1 |
| 18 | SV40-nLbCas12a-5R-MMLV-RT-SV40 (SEQ ID NO: 74) | aadA Thr61 (plasmid) | Lawn |
| 19 | SV40-nLbCas12a-5R-MMLV-RT-SV40 (SEQ ID NO: 74) | aadA Leu115 (plasmid) | 2 |
| 20 | SV40-nLbCas12a-5R-MMLV-RT-SV40 (SEQ ID NO: 74) | aadA Asp132 (plasmid) | 0 |

For selections 9, 12, 15 and 18 (aadA Thr61 target), lawns of bacteria were observed. Isolated colonies from these plates were false positives. For selections 10, 11, 13, 14, 16, and 17 (aadA Leu115 target and aadA Asp132 target), low numbers of colonies were observed on the plates. Colonies on these plates had both the tagRNA and the target amplified by colony PCR and were sent for Sanger sequencing to confirm the edit made and to identify the tagRNA responsible for the edit. All colonies evaluated from selections 11, 14, 17 and 20 (aadA Asp132 target) were false positives. Multiple colonies from selection 10 (aadA Leu115 target) had the designed edit and an associated tagRNA. The sequencing result of the edited target is shown in FIG. 8, demonstrating a TGA→CTG edit in a defunct aadA gene, restoring antibiotic resistance.

Figure 8:
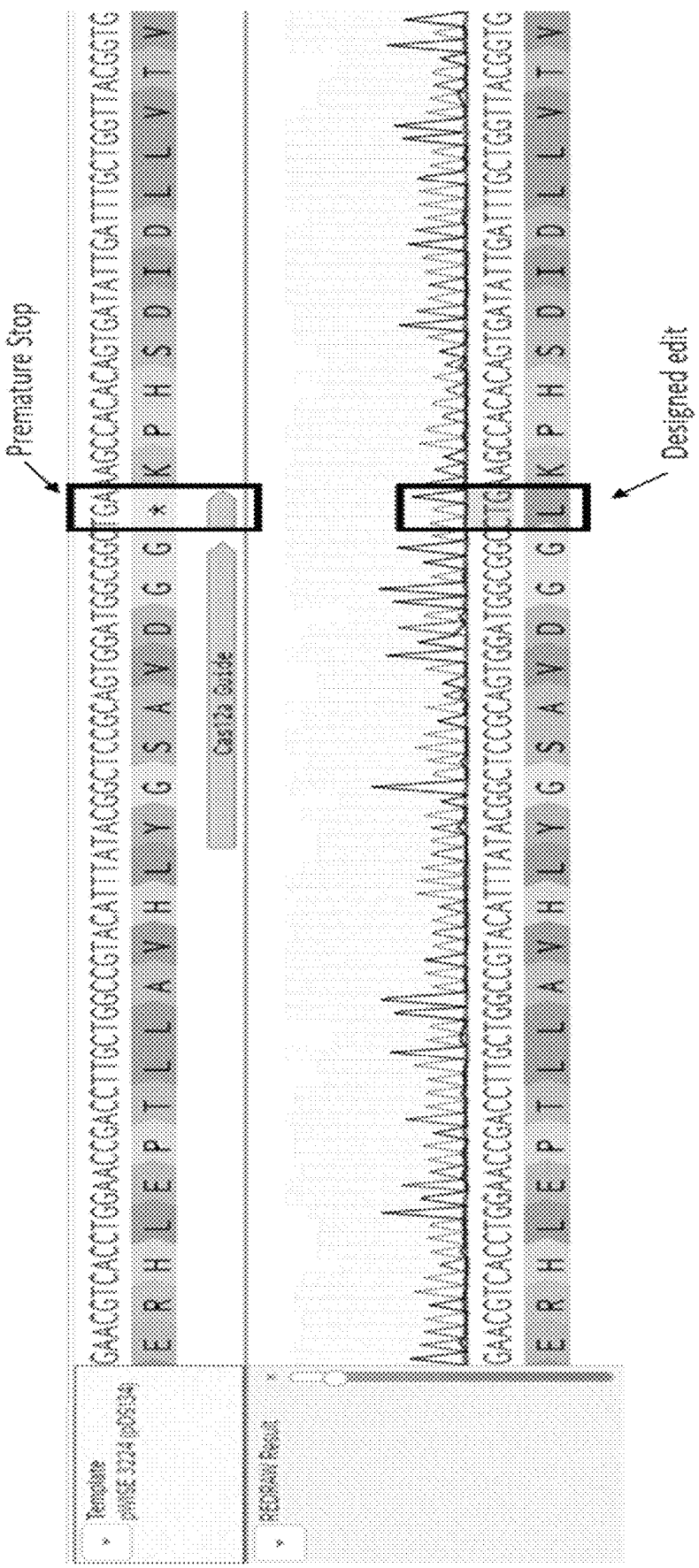
FIG. 8 shows Sanger sequencing results demonstrating a TGA>CTG edit in a defunct aadA gene, restoring antibiotic resistance. The edit was observed from a colony in Selection 10, with protein configuration SV40-MMLV-RT-XTEN-nLbCas12a-SV40 (SEQ ID NO:71).

The identified sequence of the tagRNA responsible for the edit is associated with the edit shown in FIG. 8:

(SEQ ID NO: 87)
5'-GTTTCAAAGATTAAATAATTTCTACTAAGTGTAGATTACGGCTCCGC

AGTGGATGGCGGTAATTTCTACTAAGTGTAGATGCGGCGCGTTGTTTCAT

CAAGGCGTACGGTCACCGTAACCAGCAAATCAATATCACTGTGTGGCTTC

AGGCCGCCATCCACTGCGG-3'.

The protein configuration from selection 10 is the following: SV40-nCas12a-XTEN-MMLV-RT-SV40.

Evaluation of REDRAW Editing with the Second tagRNA Library—Genomic Selection Results The number of colonies obtained from the genomic selection experiments for the second tagRNA library are summarized in Table 6 below. Colonies were observed on the rpsL selection plates.

TABLE 6

Second tagRNA library experimental results - colonies on selection plates for the genomic selections

| Selection Number | REDRAW Editor | Target | Colonies on Selection Plates |
|---|---|---|---|
| 2.1 | SV40-MMLV-RT-XTEN-nRRLbCas12a(H759A)-SV40 (SEQ ID NO: 75) | gyrA (genome) | 0 |
| 2.2 | SV40-MMLV-RT-5R-nRRLbCas12a(H759A)-SV40 (SEQ ID NO: 76) | gyrA (genome) | 0 |
| 2.3 | SV40-nRRLbCas12a(H759A)-XTEN-MMLV-RT-SV40 (SEQ ID NO: 77) | gyrA (genome) | 0 |
| 2.4 | SV40-nRRLbCas12a(H759A)-5R-MMLV-RT-SV40 (SEQ ID NO: 78) | gyrA (genome) | 0 |
| 2.5 | SV40-MMLV-RT-XTEN-nRVRLbCas12a(H759A)-SV40 (SEQ ID NO: 79) | rpsL (genome) | 5 |

TABLE 6-continued

Second tagRNA library experimental results - colonies
on selection plates for the genomic selections

| Selection Number | REDRAW Editor | Target | Colonies on Selection Plates |
|---|---|---|---|
| 2.6 | SV40-MMLV-RT-5R-nRVRLbCas12a(H759A)-SV40 (SEQ ID NO: 80) | rpsL (genome) | 8 |
| 2.7 | SV40-nRVRLbCas12a(H759A)-XTEN-MMLV-RT-SV40 (SEQ ID NO: 81) | rpsL (genome) | 2 |
| 2.8 | SV40-nRVRLbCas12a(H759A)-5R-MMLV-RT-SV40 (SEQ ID NO: 82) | rpsL (genome) | 11 |
| 2.9 | SV40-MMLV-RT-XTEN-nRRLbCas12a-SV40 (SEQ ID NO: 63) | gyrA (genome) | 0 |
| 2.10 | SV40-MMLV-RT-5R-nRRLbCas12a-SV40 (SEQ ID NO: 64) | gyrA (genome) | 0 |
| 2.11 | SV40-nRRLbCas12a-XTEN-MMLV-RT-SV40 (SEQ ID NO: 65) | gyrA (genome) | 0 |
| 2.12 | SV40-nRRLbCas12a-5R-MMLV-RT-SV40 (SEQ ID NO: 66) | gyrA (genome) | 0 |
| 2.13 | SV40-MMLV-RT-XTEN-nRVRLbCas12a-SV40 (SEQ ID NO: 67) | rpsL (genome) | 3 |
| 2.14 | SV40-MMLV-RT-5R-nRVRLbCas12a-SV40 (SEQ ID NO: 68) | rpsL (genome) | 0 |
| 2.15 | SV40-nRVRLbCas12a-XTEN-MMLV-RT-SV40 (SEQ ID NO: 69) | rpsL (genome) | 0 |
| 2.16 | SV40-nRVRLbCas12a-5R-MMLV-RT-SV40 (SEQ ID NO: 70) | rpsL (genome) | 1 |

For selections 2.1-2.4 and 2.9-2.12 (gyrA genomic target), no colonies were observed on the plates. For selections 2.5-2.8 and 2.13-2.16 (rpsL genomic target), low numbers of colonies were observed on these plates. Colonies on these plates were re-streaked to verify resistance to all antibiotics. Colonies from these plates were then used to generate PCR products of the tagRNA and the target for Sanger sequencing. Sanger sequencing was used to confirm the edit made and to identify the tagRNA responsible for the edit. All colonies from selections 2.6-2.8 and 2.13-2.16 were false positives. One colony from selection 2.5 had the designed edit AAA to CGT, which confers Streptomycin resistance (see FIG. 9).

The identified sequence of the tagRNA associated with the edit shown in FIG. 9 is:

SEQ ID NO: 92
5'-TATTTCTATAAGTGTAGATTACTCGTGTATATATACTCCGCACCGAG
GTTGGTACGAACACCGGGAGTCTTTAACACGACCGCCACGGATCAGGATC
ACGGAGTGCTCCTGCAGGTTGTGACCTTCACCACCGATGTAGGAAGTCAC
TTCGAAACCGTTAGTCAGACGAACACGGCATACTTTACGCAGCGCGGAGT
TCGGTTTACGAGGAGTGGTAGTATATACACGAGT-3'.

The protein configuration from selection 2.5 is the following: V40-MMLV-RT-XTEN-nRVRLbCas12a(H759A)-TV40.

Evaluation of REDRAW Editing with the Second tagRNA Library—Plasmid Selection Results The number of colonies obtained from the plasmid selection experiments for the second tagRNA library are summarized in Table 7 below.

TABLE 7

| Selection Number | REDRAW Editor | Target | Colonies on Selection Plates |
|---|---|---|---|
| 2.17 | SV40-MMLV-RT-XTEN-nLbCas12a-SV40 (SEQ ID NO: 71) | aadA Thr61 (plasmid) | 0 |
| 2.18 | SV40-MMLV-RT-XTEN-nLbCas12a-SV40 (SEQ ID NO: 71) | aadA Leu115 (plasmid) | 4 |
| 2.19 | SV40-MMLV-RT-XTEN-nLbCas12a-SV40 (SEQ ID NO: 71) | aadA Asp132 (plasmid) | 2 |
| 2.20 | SV40-MMLV-RT-5R-nLbCas12a-SV40 (SEQ ID NO: 72) | aadA Thr61 (plasmid) | 0 |
| 2.21 | SV40-MMLV-RT-5R-nLbCas12a-SV40 (SEQ ID NO: 72) | aadA Leu115 (plasmid) | 0 |
| 2.22 | SV40-MMLV-RT-5R-nLbCas12a-SV40 (SEQ ID NO: 72) | aadA Asp132 (plasmid) | 1 |
| 2.23 | SV40-nLbCas12a-XTEN-MMLV-RT-SV40 (SEQ ID NO: 73) | aadA Thr61 (plasmid) | 0 |
| 2.24 | SV40-nLbCas12a-XTEN-MMLV-RT-SV40 (SEQ ID NO: 73) | aadA Leu115 (plasmid) | 0 |
| 2.25 | SV40-nLbCas12a-XTEN-MMLV-RT-SV40 (SEQ ID NO: 73) | aadA Asp132 (plasmid) | 9 |

TABLE 7-continued

| Selection Number | REDRAW Editor | Target | Colonies on Selection Plates |
|---|---|---|---|
| 2.26 | SV40-nLbCas12a-5R-MMLV-RT-SV40 (SEQ ID NO: 74) | aadA Thr61 (plasmid) | 0 |
| 2.27 | SV40-nLbCas12a-5R-MMLV-RT-SV40 (SEQ ID NO: 74) | aadA Leu115 (plasmid) | 0 |
| 2.28 | SV40-nLbCas12a-5R-MMLV-RT-SV40 (SEQ ID NO: 74) | aadA Asp132 (plasmid) | 2 |
| 2.29 | SV40-MMLV-RT-XTEN-nLbCas12a(H759A)-SV40 (SEQ ID NO: 83) | aadA Thr61 (plasmid) | 0 |
| 2.30 | SV40-MMLV-RT-XTEN-nLbCas12a(H759A)-SV40 (SEQ ID NO: 83) | aadA Leu115 (plasmid) | 0 |
| 2.31 | SV40-MMLV-RT-XTEN-nLbCas12a(H759A)-SV40 (SEQ ID NO: 83) | aadA Asp132 (plasmid) | 12 |
| 2.32 | SV40-MMLV-RT-5R-nLbCas12a(H759A)-SV40 (SEQ ID NO: 84) | aadA Thr61 (plasmid) | 0 |
| 2.33 | SV40-MMLV-RT-5R-nLbCas12a(H759A)-SV40 (SEQ ID NO: 84) | aadA Leu115 (plasmid) | 0 |
| 2.34 | SV40-MMLV-RT-5R-nLbCas12a(H759A)-SV40 (SEQ ID NO: 84) | aadA Asp132 (plasmid) | 0 |
| 2.35 | SV40-nLbCas12a(H759A)-XTEN-MMLV-RT-SV40 (SEQ ID NO: 85) | aadA Thr61 (plasmid) | 0 |
| 2.36 | SV40-nLbCas12a(H759A)-XTEN-MMLV-RT-SV40 (SEQ ID NO: 85) | aadA Leu115 (plasmid) | 0 |
| 2.37 | SV40-nLbCas12a(H759A)-XTEN-MMLV-RT-SV40 (SEQ ID NO: 85) | aadA Asp132 (plasmid) | 0 |
| 2.38 | SV40-nLbCas12a(H759A)-5R-MMLV-RT-SV40 (SEQ ID NO: 85) | aadA Thr61 (plasmid) | 0 |
| 2.39 | SV40-nLbCas12a(H759A)-5R-MMLV-RT-SV40 (SEQ ID NO: 86) | aadA Leu115 (plasmid) | 1 |
| 2.40 | SV40-nLbCas12a(H759A)-5R-MMLV-RT-SV40 (SEQ ID NO: 86) | aadA Asp132 (plasmid) | 2 |

Colonies were observed on plates for the Leu115 and Asp132 selections. Selections 2.18, 2.19, 2.22, 2.25, 2.28, 2.31, 2.39, and 2.40 had colonies on the selection plates. These colonies were re-streaked to verify resistance to all antibiotics. They were then used to generate PCR products of the tagRNA and the target for Sanger sequencing. Sanger sequencing was used to confirm the edit made and to identify the tagRNA responsible for the edit. All colonies from selections 2.18, 2.19, 2.22, 2.28, 2.39, and 2.40 were false positives. Four colonies from selection 2.25 and two colonies from selection 2.31 had the designed edit and an associated tagRNA as shown in FIG. 10 and FIG. 11. The four colonies from selection 2.25 had identical edits and tagRNAs. The two colonies from selection 2.31 also had identical edits and tagRNAs.

The identified sequence of the tagRNA associated with the edit in FIG. 10 from selection 2.25 is:

```
                                           SEQ ID NO: 93
5'-TAATTTCTACTAAGTGTAGATTACGGCTCCGCAGTGGATGGCGGTAA

GTCTCCATAGAATGGAGGACAGCGCGGAGAATCTCGCTCTCTCCAGGGGA

AGCCGAAGTTTCCAAAAGGTCGTTGATCAAAGCGCGGCGCGTTGTTTCAT

CAAGGCGTACGGTCACCGTAACCAGCAAATCAATATCACTGTGTGGCTTC

AGGCCGCCATCCACTGCGGAT-3'.
```

The protein configuration from selection 2.25 is the following: SV40-nCas12a-XTEN-MMLV-RT-SV40.

The identified sequence of the tagRNA associated with the edit in FIG. 11 from selection 2.31 is:

```
                                           SEQ ID NO: 94
5'-TAATTTCAACTAAGTGTAGATTACGGCTCCGCAGTGGATGGCGGTAA

GTCTCCATAGAATGGAGGGCGGAGAATCTCGCTCTCTCCAGGGGAAGCCG

AAGTTTCCAAAAGGTCGTTGATCAAAGCGCGGCGCGTTGTTTCATCAAGG

CGTACGGTCACCGTAACCAGCAAATCAATATCACTGTGTGGCTTCAGGCC

GCCATCCACTGCGGAT-3'.
```

The protein configuration from selection 2.31 is the following: SV40-MMLV-RT-XTEN-nLbCas12a(H759)-SV40.

Summary of Observed REDRAW Editing in Bacterial Cells

Table 8 below provides a summary of the observed instances of REDRAW editing in E. coli. Described for each example is the protein configuration (REDRAW Editor), the target that was edited, the location of the tagRNA extension (5' or 3' of the Cas12a hairpin and guide), the PBS length, and the RTT length.

TABLE 8

Summary of REDRAW editing observed in E. coli.

| Selection | REDRAW Editor | Target | Extension | PBS length (bp) | RTT length |
|---|---|---|---|---|---|
| 10 | SV40-MMLV-RT-XTEN-nLbCas12a-SV40 (SEQ ID NO: 71) | aadA Leu115 (plasmid) | 3' | 17 | 96 bp |
| 2.5 | SV40-MMLV-RT-XTEN-nRVRLbCas12a(H759A)-SV40 (SEQ ID NO: 79) | rpsL (genomic) | 3' | 17 | 175 bp |
| 2.25 | SV40-nLbCas12a-XTEN-MMLV-RT-SV40 (SEQ ID NO: 73) | aadA Asp132 (plasmid) | 3' | 12 | 140 bp plus 21 bp decoy hairpin* |
| 2.31 | SV40-MMLV-RT-XTEN-nLbCas12a(H759A)-SV40 (SEQ ID NO: 83) | aadA asp132 (plasmid) | 3' | 12 | 140 bp plus 21 bp decoy hairpin* |

*Decoy hairpin sequence: TAAGTCTCCATAGAATGGAGG SEQ ID NO: 95.

Example 2. Precise Editing Activity in Human Cells

Figure 12:
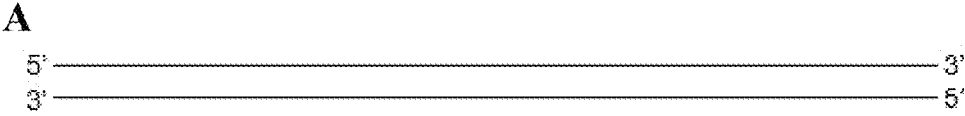
FIG. 12 shows an example editing method carried out in human cells (see Example 2). Panel A shows the double stranded target nucleic acid. Cas12a complex (complex includes the extended guide nucleic acid, which is not shown) is recruited to the first strand (target strand, bottom strand) with the 5' flap in the second strand (top strand, non-target strand), optionally being removed with a 5'-3' exonuclease (Panel B). Panel C shows the reverse transcriptase MMuLV-RT (5M)) extends from the priming site or primer (complementary to the primer binding site) on the target nucleic (dashed line=the extension). Panels D and E show the resolution of DNA intermediates via mismatch repair and DNA ligation and generation of a new edited DNA strand.
Figure 12:
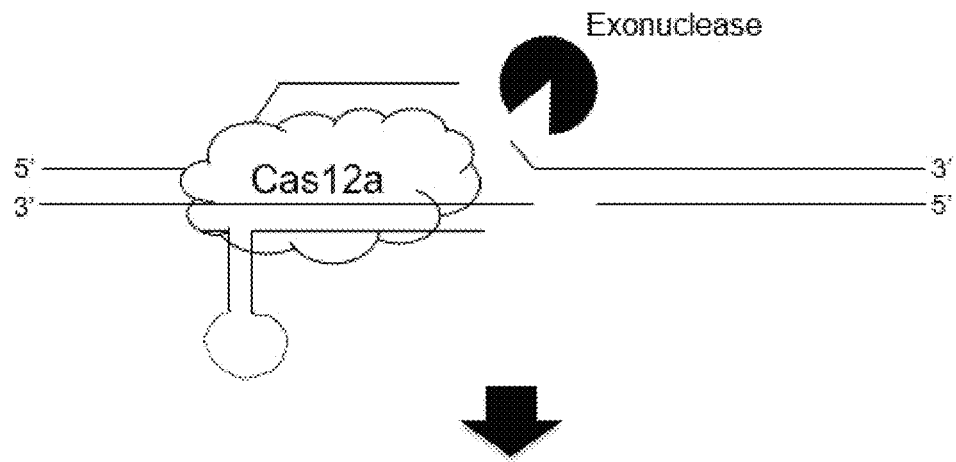
Figure 12:
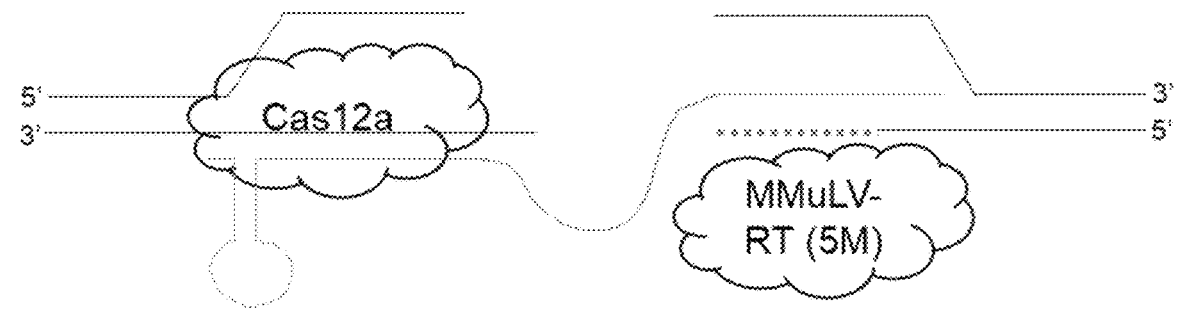
Figure 12:
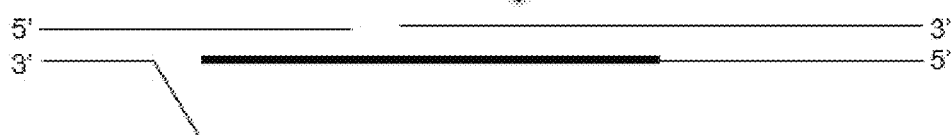
Figure 12:
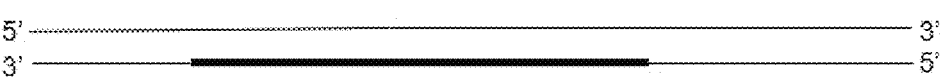

A further approach that uses the active form of Cas12a in conjunction with reverse transcriptase is shown FIG. 12. and outlined below.

Nuclease active Cas12a is recruited to the site via spacer—target site interaction.

Cas12a makes a double stranded break. Optionally, a 5' to 3' exonuclease is provided to degrade the non-template strand.

Priming occurs using the tagRNA. The primer binding site (PBS) encodes the sequences to the right of the cleavage site, complementary to the template strand DNA.

Reverse transcriptase (MMuLV-RT (5M)) extends from the priming site or primer on the target nucleic (dashed line=the extension), encoding the desired change within the newly synthesized strand.

Resolution of DNA intermediates via mismatch repair and DNA ligation generates an edited, new DNA strand.

Methods:

Extended guide RNAs were designed to target two genomic sites in HEK293T cells, DMNT1 and FANCF1. Varying combinations of primer binding sites (PBS) and reverse transcriptase template (RTT) lengths were assayed. The guide RNAs encoded a two base change in the PAM region of the target guides, corresponding to TT to AA at the -2 and -3 position (counting TTTV PAM as -4 to -1 position). The guide extensions were fused to either the 5' or the 3' end of the guide RNA.

Plasmids encoding an RNAse-dead mutant LbCas12a (H758A), reverse transcriptase (MMuLV-RT(5M)), and optionally an exonuclease (one of T5 Exonuclease, T7 Exonuclease, RecE, and RecJ), and an extended guide RNA were transfected into HEK293T cells grown at 70% confluency using Lipofectamine™ 3000 according to manufacturer's protocol. Cells were harvested after 3 days and gene editing was quantified by next generation sequencing.

Results:

We observed intended precise editing for both sites targeted. Depending on the guide design, we observed up to 0.5% editing at the FANCF1 site (FIG. 13) and up to 1.7% at the DMNT1 site (FIG. 14). Use of exonuclease improved editing efficiency in some guide designs.

TABLE 9

Figure 13:
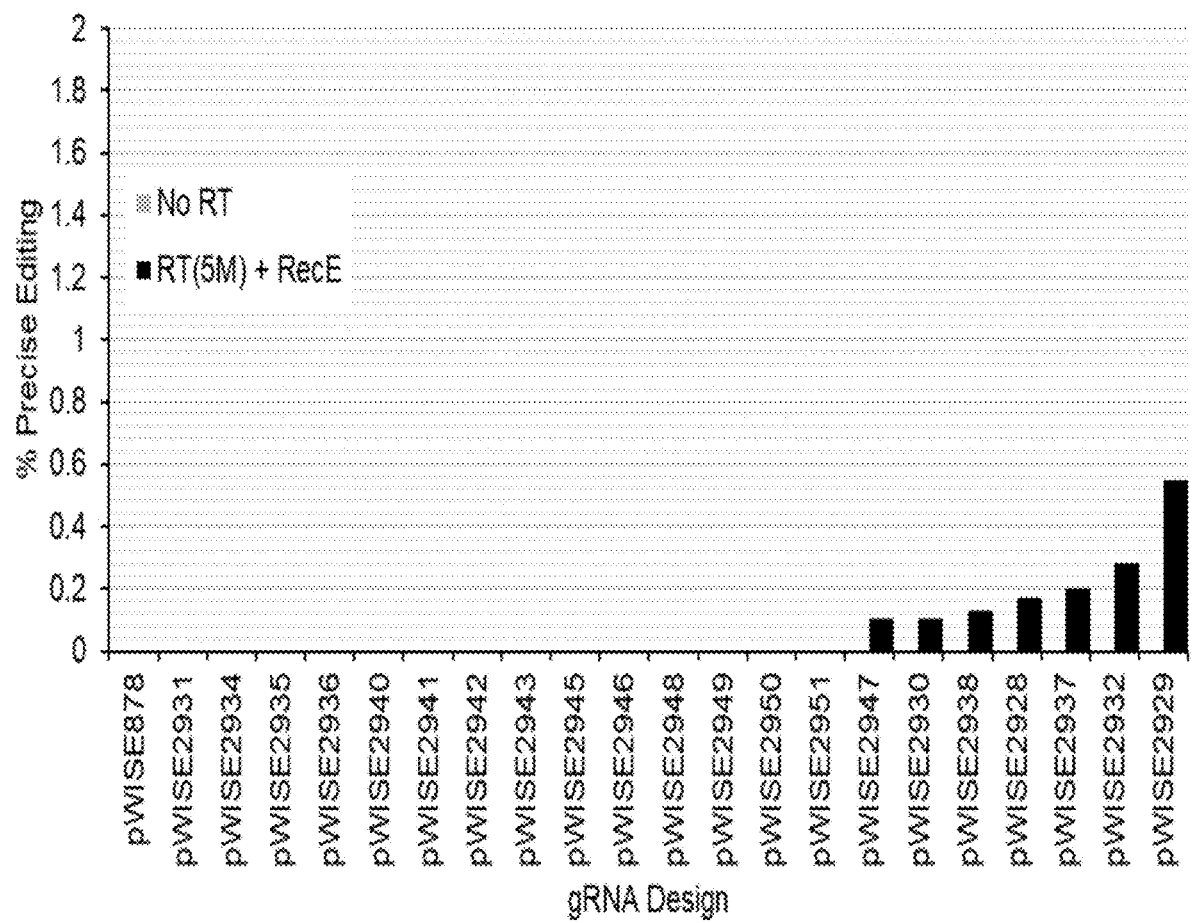
FIG. 13 shows precise editing using various guide conformations in HEK293T cells at FANCF1 site. The construct name is Cas12a (H759A)+RT(5M)+RecE FANCF1.
Figure 14:
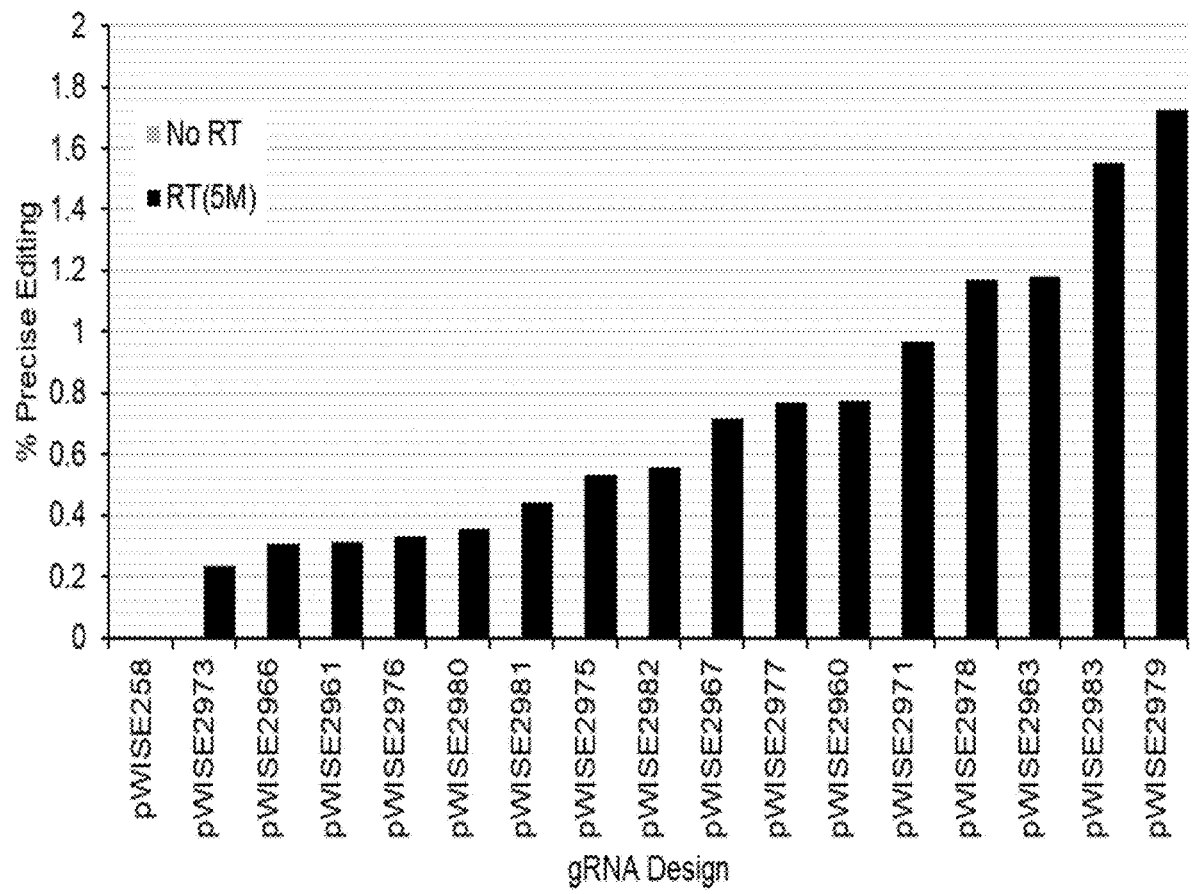
FIG. 14 shows precise editing using various guide conformations in HEK293T cells at DMNT1 site. The construct name is Cas12a (H759A)+RT(5M)+DMNT1.

Guide design used to target the FANCF1 site (FIG. 13).
FANCF1

| pWISE | 3' or 5' | RTT length (bases) | PBS length (bases) | % Precise Editing |
|---|---|---|---|---|
| pWISE878 | N/A | 0 | 0 | 0 |
| pWISE2928 | 3' | 74 | 48 | 0.17289 |
| pWISE2929 | 3' | 52 | 48 | 0.54658 |
| pWISE2930 | 3' | 44 | 48 | 0.10525 |
| pWISE2931 | 3' | 36 | 48 | 0 |
| pWISE2932 | 3' | 74 | 24 | 0.28148 |
| pWISE2934 | 3' | 44 | 24 | 0 |
| pWISE2935 | 3' | 36 | 24 | 0 |
| pWISE2936 | 3' | 74 | 16 | 0 |
| pWISE2937 | 3' | 52 | 16 | 0.20349 |
| PWISE2938 | 3' | 44 | 16 | 0.12821 |
| pWISE2940 | 3' | 74 | 8 | 0 |
| pWISE2941 | 3' | 52 | 8 | 0 |
| pWISE2942 | 3' | 44 | 8 | 0 |
| pWISE2943 | 3' | 36 | 8 | 0 |
| PWISE2945 | 5' | 52 | 48 | 0 |
| pWISE2946 | 5' | 44 | 48 | 0 |
| PWISE2947 | 5' | 36 | 48 | 0.10335 |
| PWISE2948 | 5' | 74 | 24 | 0 |
| PWISE2949 | 5' | 52 | 24 | 0 |
| PWISE2950 | 5' | 44 | 24 | 0 |
| PWISE2951 | 5' | 36 | 24 | 0 |

TABLE 10

Guide design used to target the DMNT1 site (FIG. 14).
DMNT1

| pWISE | 3' or 5' | RTT length (bases) | PBS length (bases) | % Precise Editing |
|---|---|---|---|---|
| pWISE258 | N/A | 0 | 0 | 0 |
| pWISE2960 | 3' | 74 | 48 | 0.77529 |
| pWISE2961 | 3' | 52 | 48 | 0.3139 |
| pWISE2963 | 3' | 36 | 48 | 1.17854 |
| pWISE2966 | 3' | 44 | 24 | 0.30752 |
| pWISE2967 | 3' | 36 | 24 | 0.71539 |
| pWISE2971 | 3' | 36 | 16 | 0.96806 |
| pWISE2973 | 3' | 52 | 8 | 0.23422 |
| pWISE2975 | 3' | 36 | 8 | 0.53485 |
| pWISE2976 | 5' | 74 | 48 | 0.33196 |
| pWISE2977 | 5' | 52 | 48 | 0.77164 |

TABLE 10-continued

Guide design used to target the DMNT1 site (FIG. 14).
DMNT1

| pWISE | 3' or 5' | RTT length (bases) | PBS length (bases) | % Precise Editing |
|---|---|---|---|---|
| pWISE2978 | 5' | 44 | 48 | 1.17289 |
| pWISE2979 | 5' | 36 | 48 | 1.72435 |
| pWISE2980 | 5' | 74 | 24 | 0.3538 |
| pWISE2981 | 5' | 52 | 24 | 0.44055 |
| pWISE2982 | 5' | 44 | 24 | 0.55662 |
| pWISE2983 | 5' | 36 | 24 | 1.55194 |

Figure 15:
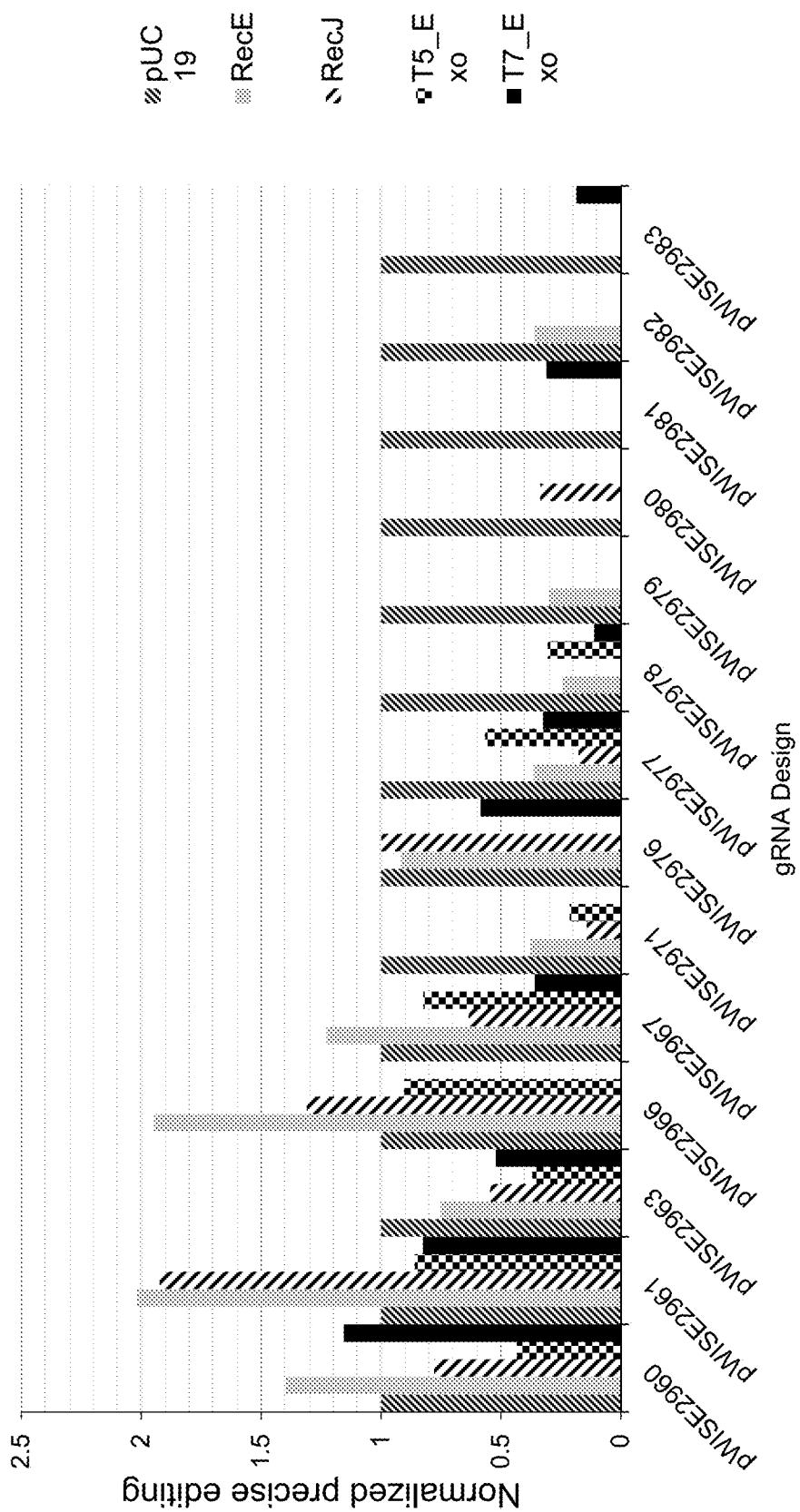
FIG. 15 shows the effect of exonuclease transfection on precise editing activity (normalized to no exonuclease treatment; pUC19=1) at DMNT1 site.

The effect of exonuclease transfection on precise editing activity at DMNT1 site is shown in FIG. 15 (normalized to no exonuclease treatment; pUC19=1). Exonuclease improves editing with some guide configurations.

The foregoing is illustrative of the present invention, and is not to be construed as limiting thereof. The invention is defined by the following claims, with equivalents of the claims to be included therein.

SEQUENCE LISTING (105 sequences)

SEQ ID NO: 1 - protein, 1228 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1241 aa, Utyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 4 - protein, 1238 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 5 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 6 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 7 - protein, 1206 aa, Unknown
  Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 8 - protein, 1233 aa, Unknown
  Lachnospiraceae bacterium
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 9 - protein, 1227 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 10 - protein, 1264 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 11 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 12 - protein, 1352 aa, Unknown
  Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 13 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 14 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 15 - protein, 1484 aa, Unknown
  Peregrinibacteria bacterium
  misc_feature (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 16 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 17 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 18 - DNA, 3987 bp, Artificial
  Cas12a polynucleotide
atggccgggagcaagaagcgccggataaagcaggacacgcagttcgagggcttcaccaacctgtaccaagtctccaagacgctccggttcgagcttatcccgcaagggaagaccctgaaacacatccaggaacaaggtttcatcgaggaggacaaggcccgcaacgaccactacaaggagctcaagcccataatcgatcggatctacaagacgtacgccgaccagtgcctccaactggtgcagctcgactgggagaacctgagcgccgccattgacagctaccgcaaggaaaagacggaggagacgcgcaacgcccttattgaggagcaagccacctaccgcaacgccatccacgactacttcatcgggcgcaccgacaacctgacggacgcgatcaacaagcgccacgcggaaatctacaagggccttttcaaggccgagctcttcaacgggaaggtcctaaaacagctcgggactgtcacgacaaccgagcatgagaacgccctccttcgcagcttcgacaagttcaccacatacttctcgggcttctaccggaaccgcaagaacgttttcagcgccgaggacatctccaccgccatcccgcacaggatcgtccaggacaacttccccaagttcaaggagaactgccacatcttcacgcgcctgattacagccgtaccttcacttcgtgagcacttcgagaacgtcaaaaaggccatcgggatcttcgtctccacgtccatcgaggaggtattctctttcccgttctataaccagctcctgacccagacgcagatcgacctctacaaccagctactgggcggcatcagccgggaggccgggaccgagaaaataaagggcctcaacgaagttctcaacctggccatccagaagaacgacgagaccgcgcatatcatcgcatccctgccgcatcgcttcattcctttgttcaagcagatattgagcgaccggaacaccctctcgttcatcctcgaagaattcaagagcgacgaggaggtcattcagtctttctgcaagtacaagacgctcctacggaatgagaatgtgctggagaccgcggaggcactcttcaatgagctgaactccattgacctgacccacatcttcattagccacaagaaactggagacgatctccagcgccctgtgcgaccactgggacactctccgcaacgccctctacgaacgccggatctccgaacttaccggcaagataactaagtcggctaaggagaaggtgcaacggagcctcaagcacgaggacatcaaccttcaggaaatcatctcagccgcgggcaaggagctgagcgaggcgtttaagcagaaaacatcggagatactgagccacgcgcacgcggccctggatcaaccgctgccgacgactctcaagaagcaagaggagaaggaaatccttaagtcccagctcgactcgctgctcggcctctatcacttgctcgactggttcgcggttgatgagtccaacgaggtggacccggagttctccgcgcgcctcacgggtattaagctggagatggagccaagcttaagcttctacaacaaggcccgcaactacgcgaccaaaaaaccgtactcagtcgagaaattcaagctgaatttccagatgcctacattggcgagggggtgggacgtgaaccgcgagaagaacaatggagccatcctgttcgtcaaaaatgggttgtactacctgggcatcatgcccaagcagaagggccgttacaaggccctgtcattcgagcctaccgagaagacctcggagggcttcgacaagatgtactacgactatttcccggacgccgccaagatgatcccgaagtgctccacgcagctcaaagccgtcacggcccacttccagacgcataccacgccgatacttctgagcaacaacttcattgagccgctagagatcacgaaggagatatacgacctaaacaaccccgaaaaggagcccaagaagttccagacagcctacgctaagaagacaggtgatcagaagggatatagggaggcactctgcaagtggatcgacttcacgcgcgacttcctgtcgaaatatacaaagacgaccagcattgacctaagttctctccgcccatcctcccagtacaaggatctgggcgagtattatgcggagctgaacccattgctgtaccacatcagcttccagaggatcgccgagaaggagattatggacgcggtggagacggggaaactatacctgttccaaatatataacaaggacttcgctaaagggcaccacgggaagcccaacctgcacacactctactggacgggcttgttttcgccagaaaatttggccaagacttcgatcaagctcaacggccaggcggagttgttttaccgtcccaagtctcgcatgaagcgcatggcgcatcgcctcggagagaaaatgcttaacaagaagctcaaggatcagaagacgcccatacctgatacgttgtaccaggaattgtacgactacgtgaaccaccgcctatcgcacgacctctcagacgaggcccgcgccctcctcccaaacgtgattactaaggaggtttcccatgaaataatcaaggaccgacggttcaccagcgacaaattttttttccacgtgcctatcacgctcaattaccaggcggccaactccccatcgaagttcaaccagcgcgtgaacgcctaccttaaggagcacccggagaccccaatcatcgggatcgaccgtggcgagcggaacctgatctatattacggtgatcgatagcaccgggaagatcctggagcagcgctccctgaacacaatccagcagtttgactaccagaagaaactcgacaaccgggagaaggagcgcgtcgcagcccggcaagcatggagtgtggtcggcaccataaaggacctgaaacagggttacctaagtcaagttatccacgagatcgttgacctgatgatacactatcaagccgtagtcgtgctggagaacctcaacttcgggtttaagtccaagcgcaccggcatcgcggagaaggcggtgtaccagcagttcgagaagatgctgatcgacaagctgaactgcctggtgctcaaggactaccctgcggagaaggtcggcggggtcttgaacccgtaccagctaaccgaccagttcacgagcttcgccaaaatgggcacgcagtccggattcttgttttatgtcccggctccatatacaagtaagatcgacccgctgacagggtttgttgacccattcgtgtggaagaccatcaagaaccacgagagcaggaaacacttcttagagggcttcgacttcctgcattacgacgttaagacaggcgacttcatcctgcacttcaagatgaaccgcaacctgtcgttccagaggggcctgcccggcttcatgcccgcctgggatatcgtctttgagaagaatgagacgcagttcgacgcgaaggggacgccgttcatcgctggaaagcggatcgtgccggtcatcgagaaccaccgcttcacgggtcgctaccgagatttataccccgccaacgaactaattgcgctgctggaggagaaggggatcgtgttccgagatggcagcaacattctcccgaagctgctggagaacgacgactcgcacgctattgacacgatggtcgccctcatacggagcgtgcttcagatgcggaacagtaacgctgccacgggcgaggactacattaactcccccgtccgcgacctcaacggggtctgcttcgatagccgcttccagaacccggagtggcctatggatgcggacgcgaacggggcctaccacatcgccctcaagggccaactcctgctcaaccacttgaaggaaagcaaagacctcaaattgcagaatggcatcagtaaccaggactggctcgcgtacatccaggaactgagaaacgggtccaagaagcggcgtatcaagcaagattga

SEQ ID NO: 19 - DNA, 3987 bp, Artificial
  Cas12a polynucleotide
atggcgggaagcaaaaagcgccggattaagcaagacacgcagttcgagggcttcacgaacctctaccaagtcagcaagaccctccggttcgagctgataccacagggaaagacgctcaagcacatccaggaacagggcttcatcgaggaggacaaggcgcgcaacgaccactacaaggagttgaaaccgatcatcgaccgcatctacaagacgtacgccgaccagtgcctccagctcgtgcagctcgactgggagaacctctccgccgccattgactcgtaccggaaggagaagactgaggagacccgcaacgccctgatcgaggagcaagcaacctaccggaacgccatccacgactacttcatcggccgcaccgacaacctcaccgacgcgatcaacaagcggcacgcggagatatacaaagggctgttcaaggcggagctgttcaacggcaaggtgctcaagcagctagggacggtgaccacgaccgagcacgagaacgcgctcctccgcagcttcgacaagttcaccacctacttcagcggcttctaccggaaccgcaagaatgtgttcagcgcggaggacatcagcacggccatcccgcaccgcatcgtccaggacaacttcccgaagttcaaggagaactgccacatcttcacccgcctgataaccgccgtcccctccctgcgggagcacttcgagaacgtcaaaaaggcaattgggatcttcgtctcgaccagcattgaggaggtgttcagcttccccttctacaaccagctcctcacccagacgcagatcgacctgtacaatcagttgctcggcgggataagccgcgaggcgggaaccgaaaaaatcaaggggctgaacgaagtgttgaacctcgccatccagaagaacgacgagaccgcgcacatcatcgcctccctgccccaccggttcatcccgctgttcaagcagatcctctctgaccggaacaccctgtccttcattcttgaggagttcaagtcggacgaggaggtcatccagagcttctgcaagtacaagacgctgctacggaacgagaacgtgctggagacggcggaggcactgttcaacgagctaaacagcatcgacctcacgcacatcttcatcagtcacaagaaactggagaccatctcctccgcgctgtgcgaccactgggacacgctcaggaacgcgctctacgagcgccgaatcagtgagctgacgggcaagatcacgaagtccgcgaaggagaaggtgcagcggtccctcaagcacgaggacatcaacctccaggagatcatctcagcggctgggaaagagctgtccgaggcgttcaagcagaaaacgagcgaaatcctgtcccacgcgcacgcggccctggatcagcctctgccgacgaccctcaagaaacaagaagaaaaggaaatcctcaagtcgcagctcgactcgctgctgggcctgtaccatctcctcgactggttcgccgtggacgagagcaacgaggtggaccccgagttctccgcgcggcttacggggatcaagctggagatggagcccagcctgtccttctacaacaaggcgcgcaactacgccaccaagaagccctacagcgtggagaagttcaagctcaacttccagatgcccactctcgcacgtgggtgggacgtcaaccgcgaaaaaaataatggggcgatcctgttcgtcaagaacggcctgtactacttgggcatcatgccgaaacagaagggccgctacaaggccctgagcttcgaaccgaccgagaaaacgagcgaggggttcgacaagatgtactacgactacttccccgacgccgcgaagatgattccaaagtgctccacgcagcttaaggccgtgacggcccacttccagacgcacacgaccccgatcctcctcagcaacaacttcatcgagcccctggagatcacgaaggagatatacgacctgaacaacccggagaaggagcccaagaaattccagaccgcctacgccaagaagacaggcgaccaaaagggttacagggaggccctctgcaagtggatcgacttcactagggacttcctgtccaagtacaccaagactacctctatcgacctgtccagcctccgcccgtcgtcccagtacaaagatttgggcgagtattacgcggagctgaacccactgctctaccacatcagcttccagcgcatcgcggagaaggagatcatggacgcagtggagacgggcaagctatacctatttcagatatacaacaaagacttcgctaagggacaccacggcaagcctaacctgcacaccctctactggacggggctcttcagcccggagaacctcgccaagacctcgatcaagctcaacggccaggccgagctgttctaccggcccaagtcccgcatgaagcggatggcccaccggctcggggagaaaatgctcaacaagaaattgaaggaccaaaaaacgccgatacccgacaccctataccaggagctgtacgactatgtgaaccaccgcctgagccacgacctcagcgacgaggcgcgggccctcctgccgaacgtcatcacaaaggaggtcagccacgagatcatcaaggaccggcgcttcacctccgacaagtttttctttcacgtgcccatcacgctcaactaccaggccgccaactcgccgtccaagttcaaccagcgcgtgaacgcctacctcaaggagcaccccgagaccccgatcatcgggattgaccgaggggagcggaacctcatctacatcaccgtcatcgacagcaccgggaagatccttgaacagcggtcgctcaacaccatccagcagttcgactaccagaagaaactcgacaaccgggagaaggagagagtggcggcccgccaggcttggtccgtcgtcgggacgattaaggacttgaaacaaggttacctgtcgcaagtgatccacgagatcgttgacctgatgatccactaccaagccgtcgtggtcctggagaacctcaacttcggcttcaagagcaaacgaaccggcatcgcggagaaggccgtgtaccagcagttcgaaaaaatgctgatcgacaagctgaactgcctcgtgctcaaggactaccccgctgagaaggtcggcggggtgctgaacccgtaccagctcactgaccagttcaccagcttcgcaaagatgggcacccagtccggcttcctgttctacgtgcctgcgccatacacctcgaagatcgacccgctcaccgggttcgtggaccccttcgtctggaagaccatcaagaaccacgagagccgcaagcacttcctggagggcttcgacttcctccactacgacgtcaagaccggggacttcatcctgcacttcaagatgaaccgcaacctcagtttccagcgcggcctgccggggttcatgcccgcttgggatatagtcttcgagaagaatgagacgcagttcgacgcgaagggcaccccgttcatcgccgggaagcgcatcgtgccggtcatcgagaaccaccggttcaccgggcgctaccgcgacctatacccggcgaacgagttgatcgccctcctggaggagaagggcatcgtgttccgcgacggctccaacatcctcccgaagctgctcgaaaacgacgactcccacgccatcgacacgatggtcgcgctgatccggtcggtgctccagatgcggaactccaacgccgcgacgggcgaggactacatcaacagtccggtccgcgatctgaacggcgtctgcttcgactcccggttccagaaccccgagtggccgatggacgcggacgcgaacggcgcataccacatcgccctaaaagggcaattgctgctcaaccacctcaaggaatccaaagacctaaagctccagaacggcatctccaaccaggactggctggcgtacatccaggaactgcggaacgggagcaaaaaacgtcggatcaagcaagattga

SEQ ID NO: 20 - DNA, 3987 bp, Artificial
  Cas12a polynucleotide
atggcgggctccaagaaacgccggattaagcaagatacccagttcgaggggttcacgaacctctaccaagtgagcaagaccctccgattcgaactgattcctcaggggaagaccctcaagcacatccaggagcaagggttcatcgaggaggacaaggcgcggaacgaccactacaaggaactcaaacccatcatcgaccgcatctacaagacctacgccgatcagtgcctccagctcgtgcagttggactgggagaacctcagcgcggccattgactcctaccggaaggagaaaacggaggagacgcgcaacgcgctcatcgaggaacaggcaacctatcgcaacgccatccacgactacttcatcgggaggactgacaacctcactgacgcgattaacaagcgccacgcggagatatacaagggactcttcaaagcggagctgtttaacggcaaggttctcaagcaactcggcactgtgaccacgaccgagcatgagaacgccctgctccgctccttcgacaagttcaccacctacttctccgggttctaccgcaaccgcaagaatgtcttcagcgcggaggacatcagcacggccattccacatcgaatcgtccaagataacttcccgaagttcaaggagaactgccacatcttcacccgactcattactgctgtaccgtcgttacgcgaacacttcgagaacgtcaagaaggcaattggaatcttcgtctctacgtcaatagaggaggtgttcagcttccctttctacaaccagctccttacgcagacccagatagacctgtacaatcagctcctcggtgggatcagccgggaggcggggactgagaagattaaagggctcaacgaggtcttgaacctggccatccaaaaaaacgatgagacggcgcacatcatcgcctcgctgccccaccggttcatcccgctgttcaagcagatcctcagtgacaggaacaccttgagctttatcctagaggagttcaagagcgacgaggaggtgatccagagcttctgcaagtacaaaaccctgctgaggaacgagaacgtcctggagacggcggaggcgctgttcaacgagctgaactctatcgacttaactcacatattcatctcgcacaagaagctggagactattagctctgcactctgcgaccactgggacaccctccgcaacgcgctctacgagcgccgcatctcggagctgaccgggaagatcaccaaatccgcgaaggaaaaggtccagcgttccctcaaacacgaggatattaacttacaggagattatctcagcggctgggaaggagttgtcagaggcgttcaagcagaaaacttccgagatcctgagccacgcgcacgcagcgctcgaccagcctctgcccaccaccctcaaaaagcaggaagaaaaagagatcctcaagagccagttggactccctgctggggctctatcaccttctcgactggttcgccgtcgatgagtcgaacgaggtggaccccgagttctccgcccggctgaccggcatcaagctagagatggagccgtccctcagcttctacaataaggcccgcaactacgcgaccaaaaaaccctacagcgtggagaagttcaagctgaacttccagatgccgaccttagcacgcggttgggacgtaaacagggagaagaacaatggagccatcctgttcgtcaagaacgggctttactacctcgggataatgcccaagcagaagggccgctacaaggccctttccttcgagccgacggagaaaacctccgaggggttcgacaagatgtactacgactacttccccgacgccgccaagatgatcccgaagtgctcaacgcagctaaaagccgtgaccgcccacttccagacccacacgacgccgatcctgctgagcaacaacttcatcgagccccttgagatcactaaggagatatacgacctgaacaaccccgagaaggagcccaagaagtttcaaaccgcctacgccaaaaaaactggcgaccaaaagggctacagggaggcgctgtgtaagtggatcgacttcacacgcgacttcctttcgaagtatacgaagacaacctctattgacctgagcagcctgcgtcctagctcccagtacaaagatttgggcgagtactacgcggagcttaatccactactctaccacatctcattccagcgcatcgctgagaaggaaatcatggacgcggtggagacaggcaaactgtacctcttccagatatacaacaaagacttcgctaaggggcaccacgggaagcccaaccttcatacgctctactggacgggcctattcagccccgaaaatctggccaagacctccatcaagctgaacggccaagcggagctgttctacagacccaagagccggatgaagcggatggcccacaggctcggcgagaaaatgcttaacaaaaagttgaaggaccagaaaacccctatccccgacaccctctaccaggaactgtacgactacgtgaaccacaggctctcgcacgacctttccgacgaggcccgtgccctactcccgaacgtcattaccaaagaggtttcgcacgagatcatcaaggaccggcggttcacgagcgacaagtttttctttcacgtccccatcacccttaactaccaggcggccaactccccatccaagttcaaccagcgtgtgaatgcctacctcaaggagcacccagagaccccgatcattgggatcgaccggggcgagcggaacctgatctacatcaccgtcatcgactcgacgggcaagattcttgagcagagatcgttgaataccatacagcagttcgactaccagaagaaactcgacaaccgcgagaaggagcgcgtggcggcccgccaggcgtggtccgtcgttgggacgattaaggacttgaaacaaggttatctgtcccaagtcatccacgagatcgttgatctgatgatccactatcaggcagtggtggtgctggagaatctcaacttcggcttcaagagtaagcggacgggaatcgccgagaaggccgtgtaccagcagttcgagaagatgctgatcgacaagctcaactgccttgtgctgaaagactacccggccgagaaggtcggcggcgtcctcaacccgtaccaacttaccgaccagttcacctccttcgccaagatgggcactcagtccgggttcttgttctacgtccccgcaccttacacctctaagatcgaccctctgactggcttcgtagatccattcgtgtggaagaccattaagaaccacgagagccgcaagcacttcctggagggcttcgacttcctgcactacgacgtgaagaccggggacttcatccttcacttcaagatgaaccggaacctcagcttccagcggggcctgccggggttcatgcccgcctgggacatcgtgttcgagaagaacgagacccagttcgacgcgaagggcacgcccttcatcgccgggaagcgtatcgtgccggtgatcgagaaccatcgtttcacgggtcgctaccgtgacctctacccggcgaacgagcttatcgcactcctggaggagaagggcatcgtcttccgggacggctccaacatcctcccgaaactgctggaaaacgacgactctcacgccatcgacacgatggtggccctcatccggtccgtgctccaaatgcggaacagcaacgccgccaccggtgaggactacatcaacagcccggtccgggatctgaacggggtgtgcttcgattcgcggttccagaatcctgagtggccgatggacgcggatgcaaacggggcgtaccacatcgcgctcaagggccagttacttctgaaccaccttaaggagtctaaagatttgaaactccagaacgggatctcgaaccaggactggctggcctacatccaagagttgcggaacggcagcaagaagcggcggattaagcaagattag

SEQ ID NO: 21 - DNA, 1592 bp, Medicago truncatula
actgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagg

SEQ ID NO: 22 - DNA, 2000 bp, Zea mays
gtcgtgcccctctctagagataaagagcattgcatgtctaaagtataaaaaattaccacatatttttttgtcacacttatttgaagtgtagtttatctatctctatacatatatttaaacttcactctacaaataatatagtctataatactaaaataatattagtgttttagaggatcatataaataaactgctagacatggtctaaaggataattgaatattttgacaatctacagttttatctttttagtgtgcatgtgatctctctgttttttttgcaaatagcttgacctatataatacttcatccattttattagtacatccatttaggatttagggttgatggtttctatagactaatttttagtacatccattttattctttttagtctctaaattttttaaaactaaaactctattttagttttttatttaataatttagatataaaatgaaataaaataaattgactacaaataaaacaaataccctttaagaaataaaaaaactaagcaaacatttttcttgtttcgagtagataatgacaggctgttcaacgccgtcgacgagtctaacggacaccaaccagcgaaccagcagcgtcgcgtcgggccaagcgaagcagacggcacggcatctctgtagctgcctctggacccctctcgagagttccgctccaccgttggacttgctccgctgtcggcatccagaaattgcgtggcggagcggcagacgtgaggcggcacggcaggcggcctcttcctcctctcacggcaccggcagctacgggggattcctttcccaccgctccttcgctttcccttcctcgcccgccgtaataaatagacaccccctccacaccctctttccccaacctcgtgttcgttcggagcgcacacacacgcaaccagatctcccccaaatccagccgtcggcacctccgcttcaaggtacgccgctcatcctccccccccccctctctctaccttctctagatcggcgatccggtccatggttagggcccggtagttctacttctgttcatgtttgtgttagagcaaacatgttcatgttcatgtttgtgatgatgtggtctggttgggcggtcgttctagatcggagtaggatactgtttcaagctacctggtggatttattaattttgtatctgtatgtgtgtgccatacatcttcatagttacgagtttaagatgatggatggaaatatcgatctaggataggtatacatgttgatgcgggttttactgatgcatatacagagatgctttttttctcgcttggttgtgatgatatggtctggttgggcggtcgttctagatcggagtagaatactgtttcaaactacctggtggatttattaaaggataaagggtcgttctagatcggagtagaatactgtttcaaactacctggtggatttattaaaggatctgtatgtatgtgcctacatcttcatagttacgagtttaagatgatggatggaaatatcgatctaggataggtatacatgttgatgcgggttttactgatgcatatacagagatgctttttttcgcttggttgtgatgatgtggtctggttgggcggtcgttctagatcggagtagaatactgtttcaaactacctggtggatttattaattttgtatctttatgtgtgtgccatacatcttcatagttacgagtttaagatgatggatggaaatattgatctaggataggtatacatgttgatgtgggttttactgatgcatatacatgatggcatatgcggcatctattcatatgctctaaccttgagtacctatctattataataaacaagtatgttttataattattttgatcttgatatacttggatgatggcatatgcagcagctatatgtggattttttagccctgccttcatacgctatttatttgcttggtactgtttcttttgtccgatgctcaccctgttgtttggtgatacttc

SEQ ID NO: 23 - protein, 24 aa, Artificial
  GCN4 sequence
EELLSKNYHLENEVARLKKGSGSG

SEQ ID NO: 24 - protein, 241 aa, Artificial
  GCN4 sequence
EEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 25 - protein, 277 aa, Artificial
  ScFv antibody
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 26 - DNA, 66 bp, Saccharomyces bayanus
ttcttgtcgtacttatagatcgctacgttatttcaattttgaaaatctgagtcctgggagtgcgga

SEQ ID NO: 27 - protein, 609 aa, Homo sapiens [sequence omitted]

SEQ ID NO: 28 - protein, 482 aa, Artificial
  polypeptide
MVRSGNKAAWLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISERHSIHWPCRLTIGSNLSIRIAAYKSILQERVKKTTWDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDIWAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAK

SEQ ID NO: 29 - DNA, 10 bp, Methanobacterium thermoautotrophicum
aatttttgga

SEQ ID NO: 30 - protein, 83 aa, Methanobacterium thermoautotrophicum
GSVIDVSSQRVNVQRPLDALGNSLNSPVIIKLKGDREFRGVLKSFDLHMNLVLNDAEELEDGEVTRRLGTVLIRGDNIVYISP

SEQ ID NO: 31 - DNA, 25 bp, Escherichia virus MS2
gcgcacatgaggatcacccatgtgc

SEQ ID NO: 32 - protein, 116 aa, Escherichia virus MS2
MASNFTQFVLVDNGGTGDVTVAPSNFANGIAEISSNSRSQAYKVTCSVRQSSAQNRKYTIKVEVPKGAWRSYLNMELTIPIFATNSDCELIVKAMQGLLKDGNPIPSAIAANSGIY

SEQ ID NO: 33 - DNA, 26 bp, Bacteriophage PP7
ataaggagtttatatggaaaccctta

SEQ ID NO: 34 - protein, 127 aa, Bacteriophage PP7
MSKTIVLSVGEATRTLTEIQSTADRQIFEEKVGPLVGRLRLTASLRQNGAKTAYRVNLKLDQADWDCSTSVCGELPKVRYTQVWSHDVTIVANSTEASRKSLYDLTKSLVATSQVEDLVVNLVPLGR

SEQ ID NO: 35 - DNA, 19 bp, Unknown
  Shigella virus
ctgaatgcctgcgagcatc

SEQ ID NO: 36 - protein, 62 aa, Unknown
  Shigella virus
MKSIRCKNCNKLLFKADSFDHIEIRCPRCKRHIIMLNACEHPTEKHCGKREKITHSDETVRY

SEQ ID NO: 37 - protein, 79 aa, Homo sapiens
RVLYVGGLAEEVDDKVLHAAFIPFGDITDIQIPLDYETEKHRGFAFVEFELAEDAAAAIDNMNESELFGRTIRVNLAKP

SEQ ID NO: 38 - protein, 78 aa, Homo sapiens
RSIYVGNVDYGATAEELEAHFHGCGSVNRVTILCDKFSGHPKGFAYIEFSDKESVRTSLALDESLFRGRQIKVIPKRT

SEQ ID NO: 39 - protein, 73 aa, Homo sapiens
NWLVLKNLTPQIDGSTLRTLCMQHGPLITFHLNLPHGNALVRYSSKEEVVKAQKSLHMCVLGNTTILAEFASE

SEQ ID NO: 40 - protein, 79 aa, Homo sapiens
GKLFVGGLSFDTNEQSLEQVFSKYGQISEVVVVKDRETQRSRGFGFVTFENIDDAKDAMMAMNGKSVDGRQIRVDQAGK

SEQ ID NO: 41 - protein, 74 aa, Homo sapiens
LIPVKQYPKFNFVGKLLGPRGNSLKRLQEETGAKMSILGKGSMRDKAKEEELRKSGEAKYAHLSDELHVLISEQ

SEQ ID NO: 42 - protein, 67 aa, Homo sapiens
LIPVKQFPKFNFVGKLLGPRGNSLKRLQEETLTKMSILGKGSMRDKAKEEELRKSGEAKYFHLNDDL

SEQ ID NO: 43 - protein, 62 aa, Homo sapiens
PEVFQVQTRLLKAIFGPDGSRIPYIEQVSKAMLELKALESSDLTEVVVYGSYLYKLRTKWML

SEQ ID NO: 44 - protein, 71 aa, Mus musculus
QVLGTVKWFNVRNGYGFINRNDTKEDVFVHQTAIKRNNPRKFLRSVGDGETVEFDVVEGEKGARAANVTGP

SEQ ID NO: 45 - protein, 71 aa, Mus musculus
KVLGTVKWFNVRNGYGFINRNDTKEDVFVHQTAIKKNNPRKYLRSVGDGETVEFDVVEGEKGAEAANVTGP

SEQ ID NO: 46 - protein, 138 aa, Homo sapiens
ARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLF

SEQ ID NO: 47 - protein, 343 aa, Homo sapiens
GRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQVISEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYY

SEQ ID NO: 48 - protein, 23 aa, Homo sapiens
FFCDTCDRGFKNQEKYDKHMSEH

SEQ ID NO: 49 - protein, 23 aa, Homo sapiens
CQMCQKQCRDENGFKCHCMSESH

SEQ ID NO: 50 - protein, 79 aa, Homo sapiens
TSLKVDNLTYRTSPDTLRRVFEKYGRVGDVYIPRDRYTKESRGFAFVRFHDKRDAEDAMDAMDGAVLDGRELRVQMARY

SEQ ID NO: 51 - protein, 84 aa, Drosophila melanogaster
QLFLGNIPHHASEDDLREIFSRFGNVLELRILSKAGNKVPPGMRSPLNYGFITYDDPEAVQKCLANCPLYFPENSPDGQKLNVE

SEQ ID NO: 52 - protein, 79 aa, Homo sapiens
GKLFVGGLNFNTDEQALEDHFSSFGPISEVVVVKDRETQRSRGFGFITFTNPEHASVAMRAMNGESLDGRQIRVDHAGK

SEQ ID NO: 53 - protein, 683 aa, Moloney murine leukemia virus
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 54 - DNA, 19 bp, Artificial
  RNA  spacer
  misc_feature (1)..(19): wherein n is A, C, T or G
nnnnnnnnnnnnnnnnnnn

SEQ ID NO: 55 - DNA, 22 bp, Artificial
  Target strand
  misc_feature (4)..(22): wherein n is A, C, T or G
aaannnnnnnnnnnnnnnnnnn

SEQ ID NO: 56 - DNA, 22 bp, Artificial
  Non-target strand
  misc_feature (4)..(22): wherein n is A, C, T or G
tttnnnnnnnnnnnnnnnnnnn

SEQ ID NO: 57 - DNA, 3790 bp, Artificial
  wtLbCas12a_NpNLS_6His_NcoI_to_NotI
ccatgggcagcaaactggaaaaatttacgaattgttatagcctgtccaagaccctgcgtttcaaagccatccccgttggcaaaacccaggagaatattgataataaacgtctgctggttgaggatgaaaaaagagcagaagactataagggagtcaaaaaactgctggatcggtactacctgagctttataaatgacgtgctgcatagcattaaactgaaaaatctgaataactatattagtctgttccgcaagaaaacccgaacagagaaagaaaataaagagctggaaaacctggagatcaatctgcgtaaagagatcgcaaaagcttttaaaggaaatgaaggttataaaagcctgttcaaaaaagacattattgaaaccatcctgccggaatttctggatgataaagacgagatagcgctcgtgaacagcttcaacgggttcacgaccgccttcacgggctttttcgataacagggaaaatatgttttcagaggaagccaaaagcacctcgatagcgttccgttgcattaatgaaaatttgacaagatatatcagcaacatggatattttcgagaaagttgatgcgatctttgacaaacatgaagtgcaggagattaaggaaaaaattctgaacagcgattatgatgttgaggattttttcgagggggaattttttaactttgtactgacacaggaaggtatagatgtgtataatgctattatcggcgggttcgttaccgaatccggcgagaaaattaagggtctgaatgagtacatcaatctgtataaccaaaagaccaaacagaaactgccaaaattcaaaccgctgtacaagcaagtcctgagcgatcgggaaagcttgagcttttacggtgaaggttataccagcgacgaggaggtactggaggtctttcgcaataccctgaacaagaacagcgaaattttcagctccattaaaaagctggagaaactgtttaagaattttgacgagtacagcagcgcaggtatttttgtgaagaacggacctgccataagcaccattagcaaggatatttttggagagtggaatgttatccgtgataaatggaacgcggaatatgatgacatacacctgaaaaagaaggctgtggtaactgagaaatatgaagacgatcgccgcaaaagctttaaaaaaatcggcagctttagcctggagcagctgcaggaatatgcggacgccgacctgagcgtggtcgagaaactgaaggaaattattatccaaaaagtggatgagatttacaaggtatatggtagcagcgaaaaactgtttgatgcggacttcgttctggaaaaaagcctgaaaaaaaatgatgctgttgttgcgatcatgaaagacctgctcgatagcgttaagagctttgaaaattacattaaagcattctttggcgagggcaaagaaacaaacagagacgaaagcttttatggcgacttcgtcctggcttatgacatcctgttgaaggtagatcatatatatgatgcaattcgtaattacgtaacccaaaagccgtacagcaaagataagttcaaactgtatttccagaacccgcagtttatgggtggctgggacaaagacaaggagacagactatcgcgccactattctgcgttacggcagcaagtactatctcgccatcatggacaaaaaatatgcaaagtgtctgcagaaaatcgataaagacgacgtgaacggaaattacgaaaagattaattataagctgctgccagggcccaacaagatgttaccgaaagtatttttttccaaaaaatggatggcatactataacccgagcgaggatatacagaagatttacaaaaatgggaccttcaaaaagggggatatgttcaatctgaatgactgccacaaactgatcgatttttttaaagatagcatcagccgttatcctaaatggtcaaacgcgtatgattttaatttctccgaaacggagaaatataaagacattgctggtttctatcgcgaagtcgaagaacagggttataaagttagctttgaatcggccagcaagaaagaggttgataaactggtggaggagggtaagctgtatatgtttcagatttataacaaagactttagcgacaaaagccacggtactcctaatctgcatacgatgtactttaaactgctgtttgatgagaataaccacggccaaatccgtctctccggtggagcagaactttttatgcggcgtgcgagcctaaaaaaggaagaactggtggtgcatcccgccaacagcccgattgctaacaaaaatccagataatcctaagaagaccaccacactgtcgtacgatgtctataaggataaacgtttctcggaagaccagtatgaattgcatataccgatagcaattaataaatgcccaaaaaacattttcaaaatcaacactgaagttcgtgtgctgctgaaacatgatgataatccgtatgtgatcggaattgaccgtggggagagaaatctgctgtatattgtagtcgttgatggcaagggcaacatcgttgagcagtatagcctgaatgaaataattaataattttaacggtatacgtattaaaaccgactatcatagcctgctggataaaaaggagaaagagcgttttgaggcacgccaaaattggacgagcatcgaaaacatcaaggaactgaaggcaggatatatcagccaagtagtccataaaatctgtgaactggtggagaagtacgacgctgtcattgccctggaagacctcaatagcggctttaaaaacagccgggtgaaggtggagaaacaggtataccaaaagtttgaaaagatgctcattgataagctgaactatatggttgataaaaagagcaacccgtgcgccactggcggtgcactgaaagggtaccaaattaccaataaatttgaaagctttaaaagcatgagcacgcagaatgggtttattttttatataccagcatggctgacgagcaagattgaccccagcactggttttgtcaatctgctgaaaaccaaatacacaagcattgcggatagcaaaaaatttatttcgagcttcgaccgtattatgtatgttccggaggaagatctgtttgaatttgccctggattataaaaacttcagccgcaccgatgcagattatatcaaaaaatggaagctgtacagttatggtaatcgtatacgtatcttccgtaatccgaagaaaaacaatgtgttcgattgggaagaggtctgtctgaccagcgcgtataaagaactgttcaacaagtacggaataaattatcagcaaggtgacattcgcgcactgctgtgtgaacagtcagataaagcattttatagcagctttatggcgctgatgagcctgatgctccagatgcgcaacagcataaccggtcgcacagatgttgactttctgatcagccctgtgaagaatagcgacggcatcttctacgattccaggaactatgaagcacaggaaaacgctattctgcctaaaaatgccgatgccaacggcgcctataatattgcacggaaggttctgtgggcgattggacagttcaagaaagcggaagatgagaagctggataaggtaaaaattgctattagcaataaggaatggctggagtacgcacagacatcggttaaacacggtagtaaaaggccggcggccacgaaaaaggccggccaggcaaaaaagaaaaagggagcggccgcactcgagcaccaccaccaccaccactgagcggccgc

SEQ ID NO: 58 - DNA, 8986 bp, Artificial
  plasmid
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatataccatgggcagcaaactggaaaaatttacgaattgttatagcctgtccaagaccctgcgtttcaaagccatccccgttggcaaaacccaggagaatattgataataaacgtctgctggttgaggatgaaaaaagagcagaagactataagggagtcaaaaaactgctggatcggtactacctgagctttataaatgacgtgctgcatagcattaaactgaaaaatctgaataactatattagtctgttccgcaagaaaacccgaacagagaaagaaaataaagagctggaaaacctggagatcaatctgcgtaaagagatcgcaaaagcttttaaaggaaatgaaggttataaaagcctgttcaaaaaagacattattgaaaccatcctgccggaatttctggatgataaagacgagatagcgctcgtgaacagcttcaacgggttcacgaccgccttcacgggctttttcgataacagggaaaatatgttttcagaggaagccaaaagcacctcgatagcgttccgttgcattaatgaaaatttgacaagatatatcagcaacatggatattttcgagaaagttgatgcgatctttgacaaacatgaagtgcaggagattaaggaaaaaattctgaacagcgattatgatgttgaggattttttcgagggggaattttttaactttgtactgacacaggaaggtatagatgtgtataatgctattatcggcgggttcgttaccgaatccggcgagaaaattaagggtctgaatgagtacatcaatctgtataaccaaaagaccaaacagaaactgccaaaattcaaaccgctgtacaagcaagtcctgagcgatcgggaaagcttgagcttttacggtgaaggttataccagcgacgaggaggtactggaggtctttcgcaataccctgaacaagaacagcgaaattttcagctccattaaaaagctggagaaactgtttaagaattttgacgagtacagcagcgcaggtatttttgtgaagaacggacctgccataagcaccattagcaaggatatttttggagagtggaatgttatccgtgataaatggaacgcggaatatgatgacatacacctgaaaaagaaggctgtggtaactgagaaatatgaagacgatcgccgcaaaagctttaaaaaaatcggcagctttagcctggagcagctgcaggaatatgcggacgccgacctgagcgtggtcgagaaactgaaggaaattattatccaaaaagtggatgagatttacaaggtatatggtagcagcgaaaaactgtttgatgcggacttcgttctggaaaaaagcctgaaaaaaaatgatgctgttgttgcgatcatgaaagacctgctcgatagcgttaagagctttgaaaattacattaaagcattctttggcgagggcaaagaaacaaacagagacgaaagcttttatggcgacttcgtcctggcttatgacatcctgttgaaggtagatcatatatatgatgcaattcgtaattacgtaacccaaaagccgtacagcaaagataagttcaaactgtatttccagaacccgcagtttatgggtggctgggacaaagacaaggagacagactatcgcgccactattctgcgttacggcagcaagtactatctcgccatcatggacaaaaaatatgcaaagtgtctgcagaaaatcgataaagacgacgtgaacggaaattacgaaaagattaattataagctgctgccagggcccaacaagatgttaccgaaagtatttttttccaaaaaatggatggcatactataacccgagcgaggatatacagaagatttacaaaaatgggaccttcaaaaagggggatatgttcaatctgaatgactgccacaaactgatcgatttttttaaagatagcatcagccgttatcctaaatggtcaaacgcgtatgattttaatttctccgaaacggagaaatataaagacattgctggtttctatcgcgaagtcgaagaacagggttataaagttagctttgaatcggccagcaagaaagaggttgataaactggtggaggagggtaagctgtatatgtttcagatttataacaaagactttagcgacaaaagccacggtactcctaatctgcatacgatgtactttaaactgctgtttgatgagaataaccacggccaaatccgtctctccggtggagcagaactttttatgcggcgtgcgagcctaaaaaaggaagaactggtggtgcatcccgccaacagcccgattgctaacaaaaatccagataatcctaagaagaccaccacactgtcgtacgatgtctataaggataaacgtttctcggaagaccagtatgaattgcatataccgatagcaattaataaatgcccaaaaaacattttcaaaatcaacactgaagttcgtgtgctgctgaaacatgatgataatccgtatgtgatcggaattgaccgtggggagagaaatctgctgtatattgtagtcgttgatggcaagggcaacatcgttgagcagtatagcctgaatgaaataattaataattttaacggtatacgtattaaaaccgactatcatagcctgctggataaaaaggagaaagagcgttttgaggcacgccaaaattggacgagcatcgaaaacatcaaggaactgaaggcaggatatatcagccaagtagtccataaaatctgtgaactggtggagaagtacgacgctgtcattgccctggaagacctcaatagcggctttaaaaacagccgggtgaaggtggagaaacaggtataccaaaagtttgaaaagatgctcattgataagctgaactatatggttgataaaaagagcaacccgtgcgccactggcggtgcactgaaagggtaccaaattaccaataaatttgaaagctttaaaagcatgagcacgcagaatgggtttattttttatataccagcatggctgacgagcaagattgaccccagcactggttttgtcaatctgctgaaaaccaaatacacaagcattgcggatagcaaaaaatttatttcgagcttcgaccgtattatgtatgttccggaggaagatctgtttgaatttgccctggattataaaaacttcagccgcaccgatgcagattatatcaaaaaatggaagctgtacagttatggtaatcgtatacgtatcttccgtaatccgaagaaaaacaatgtgttcgattgggaagaggtctgtctgaccagcgcgtataaagaactgttcaacaagtacggaataaattatcagcaaggtgacattcgcgcactgctgtgtgaacagtcagataaagcattttatagcagctttatggcgctgatgagcctgatgctccagatgcgcaacagcataaccggtcgcacagatgttgactttctgatcagccctgtgaagaatagcgacggcatcttctacgattccaggaactatgaagcacaggaaaacgctattctgcctaaaaatgccgatgccaacggcgcctataatattgcacggaaggttctgtgggcgattggacagttcaagaaagcggaagatgagaagctggataaggtaaaaattgctattagcaataaggaatggctggagtacgcacagacatcggttaaacacggtagtaaaaggccggcggccacgaaaaaggccggccaggcaaaaaagaaaaagggagcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 59 - RNA, 43 nt, Artificial
  CRISPR RNA
aauuucuacuaaguguagauggaaucccuucugcagcaccugg

SEQ ID NO: 60 - DNA, 28 bp, Artificial
  protospacer
ctttcggaatcccttctgcagcacctgg

SEQ ID NO: 61 - DNA, 133 bp, Homo sapiens
gtaagtatcaaggttacaagacaggtttaaggagaccaatagaaactgggcttgtcgagacagagaagactcttgcgtttctgataggcacctattggtcttactgacatccactttgcctttctctccacag

SEQ ID NO: 62 - DNA, 99 bp, Simian virus 40
gtaagtttagtctttttgtcttttatttcaggtcccggatccggtggtggtgcaaatcaaagaactgctcctcagtggatgttgcctttacttctaggc

SEQ ID NO: 63 - protein, 1963 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGSETPGTSESATPESSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 64 - protein, 1979 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 65 - protein, 1963 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 66 - protein, 1979 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSSGGSSGSETPGTSESATPESSGGSSGGSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 67 - protein, 1963 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGSETPGTSESATPESSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 68 - protein, 1979 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 69 - protein, 1963 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 70 - protein, 1979 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSSGGSSGSETPGTSESATPESSGGSSGGSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 71 - protein, 1963 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGSETPGTSESATPESSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 72 - protein, 1979 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 73 - protein, 1963 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 74 - protein, 1979 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSSGGSSGSETPGTSESATPESSGGSSGGSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 75 - protein, 1963 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGSETPGTSESATPESSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 76 - protein, 1979 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 77 - protein, 1963 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 78 - protein, 1979 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSSGGSSGSETPGTSESATPESSGGSSGGSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 79 - protein, 1963 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGSETPGTSESATPESSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 80 - protein, 1979 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 81 - protein, 1963 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 82 - protein, 1979 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDVETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSSGGSSGSETPGTSESATPESSGGSSGGSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 83 - protein, 1963 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGSETPGTSESATPESSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 84 - protein, 1979 aa, Artificial
  REDRAW editor
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSG

SEQ ID NO: 85 - protein, 1963 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 86 - protein, 1979 aa, Artificial
  REDRAW editor
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSSGGSSGSETPGTSESATPESSGGSSGGSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKVGSG

SEQ ID NO: 87 - DNA, 166 bp, Artificial
  Example tagRNA
gtttcaaagattaaataatttctactaagtgtagattacggctccgcagtggatggcggtaatttctactaagtgtagatgcggcgcgttgtttcatcaaggcgtacggtcaccgtaaccagcaaatcaatatcactgtgtggcttcaggccgccatccactgcgg

SEQ ID NO: 88 - DNA, 8019 bp, Artificial
  plasmid
gacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactctggcggctcaaaaagaaccgccgacggcagcgaattcgagcccaagaagaagaggaaagtcggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctatggagtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtctggtggttctcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtt

SEQ ID NO: 89 - DNA, 10116 bp, Artificial
  REDRAW editor
gacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtcacacttaatattgaggatgaacatagattgcacgagacctctaaggaacctgatgtttctcttggatcaacttggttgtcagatttcccacaagcatgggcagagaccggaggtatgggtcttgctgttaggcaggcaccacttattattcctttgaaggcaacctctactcctgtgtcaattaagcaatatccaatgtctcaggaagctaggcttggaattaagcctcacattcaaagacttttggatcagggtattttggtgccatgtcaatcaccttggaacacaccacttttgcctgttaagaagcctggaactaatgattacagaccagtgcaagatttgagggaggttaacaagagagtggaagatattcacccaactgttccaaacccttataatcttttgtctggattgccaccttcacatcaatggtacactgtgcttgatttgaaggatgcatttttctgccttaggttgcatccaacatctcagcctctttttgctttcgagtggagagatcctgaaatgggaatttctggtcaacttacatggaccaggttgcctcagggtttcaagaactcaccaaccttgtttaatgaggcacttcacagggatttggctgattttaggattcaacatcctgatcttatccttttgcagtatgttgatgatcttttgcttgctgcaacttctgaattggattgtcaacagggaactagggcattgcttcaaacacttggaaatttgggttacagagcttcagcaaagaaggctcagatttgccaaaagcaggttaagtatcttggatacttgcttaaggaaggacaaaggtggttgaccgaggctagaaaggaaactgtgatgggtcaaccaacacctaagacccctaggcagcttagagagttcttgggaaaggcaggtttttgtaggcttttcattccaggatttgctgaaatggctgcaccactttatcctttgaccaagcctggaactttgtttaactggggtccagatcaacagaaggcataccaagaaattaagcaggctttgcttactgctccagcacttggtttgcctgatcttacaaagccatttgagttgttcgttgatgaaaagcaaggatatgcaaagggtgtgcttacccagaagttgggaccttggagaaggcctgttgcttacctttctaagaaacttgatccagtggctgcaggttggccaccttgtcttagaatggttgctgcaattgcagtgcttacaaaggatgctggaaagttgactatgggacaacctcttgttattttggcaccacacgctgttgaggcacttgtgaagcagccacctgataggtggttgtcaaacgcaagaatgacccattatcaagctcttcttttggatactgatagggtgcagttcggtcctgttgtggctttgaatccagcaacacttttgccacttcctgaggaaggattgcaacacaactgccttgatattttggctgaggcacatggtacaagacctgatcttaccgatcagccattgcctgatgctgatcacacttggtacacagatggatcttcacttttgcaagaaggacagaggaaggctggtgctgcagttactacagagactgaagtgatttgggctaaggcacttccagctggaacatctgctcaaagagcagagcttattgctttgacccaggcacttaagatggctgaaggaaagaagttgaacgtttacactgattctaggtatgctttcgcaacagctcatattcacggagaaatctatagaaggagaggatggttgacatcagagggaaaggaaattaagaacaaggatgaaattcttgcacttttgaaggctctttttcttcctaagagattgtctattattcattgcccaggacaccaaaagggtcattcagcagaagctaggggaaatagaatggctgatcaggctgcaagaaaggctgcaattactgagacacctgatacctctactcttttgatcgaaaactcttcaccaaattcaaggcttattaactctggcagcgaaactccgggcacttccgagtcagctactcctgagtcttccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatggcgaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactctggcggctcaaaaagaaccgccgacggcagcgaattcgagcccaagaagaagaggaaagtcggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctatggagtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtctggtggttctcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtt

SEQ ID NO: 90 - DNA, 6717 bp, Artificial
  tagRNA
atgaaacggacagccgacggaagcgagttcgagtcaccaaagaagaagcggaaagtcacacttaatattgaggatgaacatagattgcacgagacctctaaggaacctgatgtttctcttggatcaacttggttgtcagatttcccacaagcatgggcagagaccggaggtatgggtcttgctgttaggcaggcaccacttattattcctttgaaggcaacctctactcctgtgtcaattaagcaatatccaatgtctcaggaagctaggcttggaattaagcctcacattcaaagacttttggatcagggtattttggtgccatgtcaatcaccttggaacacaccacttttgcctgttaagaagcctggaactaatgattacagaccagtgcaagatttgagggaggttaacaagagagtggaagatattcacccaactgttccaaacccttataatcttttgtctggattgccaccttcacatcaatggtacactgtgcttgatttgaaggatgcatttttctgccttaggttgcatccaacatctcagcctctttttgctttcgagtggagagatcctgaaatgggaatttctggtcaacttacatggaccaggttgcctcagggtttcaagaactcaccaaccttgtttaatgaggcacttcacagggatttggctgattttaggattcaacatcctgatcttatccttttgcagtatgttgatgatcttttgcttgctgcaacttctgaattggattgtcaacagggaactagggcattgcttcaaacacttggaaatttgggttacagagcttcagcaaagaaggctcagatttgccaaaagcaggttaagtatcttggatacttgcttaaggaaggacaaaggtggttgaccgaggctagaaaggaaactgtgatgggtcaaccaacacctaagacccctaggcagcttagagagttcttgggaaaggcaggtttttgtaggcttttcattccaggatttgctgaaatggctgcaccactttatcctttgaccaagcctggaactttgtttaactggggtccagatcaacagaaggcataccaagaaattaagcaggctttgcttactgctccagcacttggtttgcctgatcttacaaagccatttgagttgttcgttgatgaaaagcaaggatatgcaaagggtgtgcttacccagaagttgggaccttggagaaggcctgttgcttacctttctaagaaacttgatccagtggctgcaggttggccaccttgtcttagaatggttgctgcaattgcagtgcttacaaaggatgctggaaagttgactatgggacaacctcttgttattttggcaccacacgctgttgaggcacttgtgaagcagccacctgataggtggttgtcaaacgcaagaatgacccattatcaagctcttcttttggatactgatagggtgcagttcggtcctgttgtggctttgaatccagcaacacttttgccacttcctgaggaaggattgcaacacaactgccttgatattttggctgaggcacatggtacaagacctgatcttaccgatcagccattgcctgatgctgatcacacttggtacacagatggatcttcacttttgcaagaaggacagaggaaggctggtgctgcagttactacagagactgaagtgatttgggctaaggcacttccagctggaacatctgctcaaagagcagagcttattgctttgacccaggcacttaagatggctgaaggaaagaagttgaacgtttacactgattctaggtatgctttcgcaacagctcatattcacggagaaatctatagaaggagaggatggttgacatcagagggaaaggaaattaagaacaaggatgaaattcttgcacttttgaaggctctttttcttcctaagagattgtctattattcattgcccaggacaccaaaagggtcattcagcagaagctaggggaaatagaatggctgatcaggctgcaagaaaggctgcaattactgagacacctgatacctctactcttttgatcgaaaactcttcaccaaattcaaggcttattaactctggcagcgaaactccgggcacttccgagtcagctactcctgagtcttccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatggcgaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactctggcggctcaaaaagaaccgccgacggcagcgaattcgagcccaagaagaagaggaaagtcggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctatggagtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtctggtggttctcccaagaagaagaggaaagtctaa

SEQ ID NO: 91 - protein, 2238 aa, Artificial
  editor sequence
MKRTADGSEFESPKKKRKVTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLINSGSETPGTSESATPESSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKVGSGATNFSLLKQAGDVEENPGPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGGSPKKKRKV

SEQ ID NO: 92 - DNA, 231 bp, Artificial
  tagRNA
tatttctataagtgtagattactcgtgtatatatactccgcaccgaggttggtacgaacaccgggagtctttaacacgaccgccacggatcaggatcacggagtgctcctgcaggttgtgaccttcaccaccgatgtaggaagtcacttcgaaaccgttagtcagacgaacacggcatactttacgcagcgcggagttcggtttacgaggagtggtagtatatacacgagt

SEQ ID NO: 93 - DNA, 218 bp, Artificial
  tagRNA
taatttctactaagtgtagattacggctccgcagtggatggcggtaagtctccatagaatggaggacagcgcggagaatctcgctctctccaggggaagccgaagtttccaaaaggtcgttgatcaaagcgcggcgcgttgtttcatcaaggcgtacggtcaccgtaaccagcaaatcaatatcactgtgtggcttcaggccgccatccactgcggat

SEQ ID NO: 94 - DNA, 213 bp, Artificial
  tagRNA
taatttcaactaagtgtagattacggctccgcagtggatggcggtaagtctccatagaatggagggcggagaatctcgctctctccaggggaagccgaagtttccaaaaggtcgttgatcaaagcgcggcgcgttgtttcatcaaggcgtacggtcaccgtaaccagcaaatcaatatcactgtgtggcttcaggccgccatccactgcggat

SEQ ID NO: 95 - DNA, 21 bp, Artificial
  decoy hairpin
taagtctccatagaatggagg

SEQ ID NO: 96 - protein, 1267 aa, Artificial
  LbCas12a polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVAPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSKRTADGSEFEPKKKRKV

SEQ ID NO: 97 - protein, 717 aa, Artificial
  exonuclease
MKRTADGSEFESPKKKRKVTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 98 - protein, 343 aa, Artificial
  exonuclease
MKRTADGSEFESPKKKRKVEHPHNENAGSDPHRDCSDETGEVADPVIVEDIEPGIYYGISNENYHAGPGISKSQLDDIADTPALYLWRKNAPVDTTKTKTLDLGTAFHCRVLEPEEFSNRFIVAPEFNRRTNAGKEEEKAFLMECASTGKTVITAEEGRKIELMYQSVMALPLGQWLVESAGHAESSIYWEDPETGILCRCRPDKIIPEFHWIMDVKTTADIQRFKTAYYDYRYHVQDAFYSDGYEAQFGVQPTFVFLVASTTIECGRYPVEIFMMGEEAKLAGQQEYHRNLRTLSDCLNTDEWPAIKTLSLPRWAKEYANDSGGSKRTADGSEFEPKKKRKV

SEQ ID NO: 99 - protein, 617 aa, Artificial
  exonuclease
MKRTADGSEFESPKKKRKVMKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGDTLPAAEAIINPNLRDCNFPSKSLAGVGVAFYLMLALRTFLRDQGWFDERNIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQIEALTLCEKLERSRDTLPGGLAMYHPEWHQGVVGILASRIKERFHRPVIAFAPAGDGTLKGSGRSIQGLHMRDALERLDTLYPGMMLKFGGHAMAAGLSLEEDKFKLFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPISGGSKRTADGSEFEPKKKRKV

SEQ ID NO: 100 - protein, 330 aa, Artificial
  exonuclease
MKRTADGSEFESPKKKRKVSKSWGKFIEEEEAEMASRRNLMIVDGTNLGFRFKHNNSKKPFASSYVSTIQSLAKSYSARTTIVLGDKGKSVFRLEHLPEYKGNRDEKYAQRTEEEKALDEQFFEYLKDAFELCKTTFPTFTIRGVEADDMAAYIVKLIGHLYDHVWLISTDGDWDTLLTDKVSRFSFTTRREYHLRDMYEHHNVDDVEQFISLKAIMGDLGDNIRGVEGIGAKRGYNIIREFGNVLDIIDQLPLPGKQKYIQNLNASEELLFRNLILVDLPTYCVDAIAAVGQDVLDKFTKDILEIAEQSGGSKRTADGSEFEPKKKRKV

SEQ ID NO: 101 - protein, 340 aa, Artificial
  exonuclease
MKRTADGSEFESPKKKRKVMALLDLKQFYELREGCDDKGILVMDGDWLVFQAMSAAEFDASWEEEIWHRCCDHAKARQILEDSIKSYETRKKAWAGAPIVLAFTDSVNWRKELVDPNYKANRKAVKKPVGYFEFLDALFEREEFYCIREPMLEGDDVMGVIASNPSAFGARKAVIISCDKDFKTIPNCDFLWCTTGNILTQTEESADWWHLFQTIKGDITDGYSGIAGWGDTAEDFLNNPFITEPKTSVLKSGKNKGQEVTKWVKRDPEPHETLWDCIKSIGAKAGMTEEDIIKQGQMARILRFNEYNFIDKEIYLWRPSGGSKRTADGSEFEPKKKRKV

SEQ ID NO: 102 - DNA, 283 bp, Homo sapiens
ctgtgaggattgagtgagttgcacgtgtcaagtgcttagagcaggcgtgctgcacacagcaggcctttggtcaggttggctgctgggctggccctggggccgtttccctcactcctgctcggtgaatttggctcagcaggcacctgcctcagctgctcacttgagcctctgggtctagaaccctctggggaccgtttgaggagtgttcagtctccgtgaacgttcccttagcactctgccacttattgggtcagctgttaacatcagtacgttaatgtttcct

SEQ ID NO: 103 - DNA, 23 bp, Artificial
  spacer sequence
cctcactcctgctcggtgaattt

SEQ ID NO: 104 - DNA, 298 bp, Homo sapiens
gagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgcttt

SEQ ID NO: 105 - DNA, 23 bp, Artificial
  spacer sequence
gcggatgttccaatcagtacgca

That which is claimed is:

1. A method of modifying a target nucleic acid, the method comprising:
   contacting the target nucleic acid with
   (a) a Type V CRISPR-Cas effector protein;
   (b) a reverse transcriptase; and
   (c) an extended guide nucleic acid, wherein the extended guide nucleic acid comprises:
      (i) a Type V CRISPR nucleic acid; and
      (ii) an extended portion comprising a primer binding site and a reverse transcriptase template (RT template),
   wherein the extended portion of the extended guide nucleic acid comprises an RT template and a primer binding site, optionally wherein the extended portion is fused to either the 5' end or 3' end of the Type V CRISPR nucleic acid and/or the RT template of the extended portion is 5' of the primer binding site, and
   wherein the target nucleic acid is double stranded comprising a first strand and a second strand, the Type V CRISPR-Cas effector protein is a double stranded nuclease that cuts the first strand and the second strand of the target nucleic acid resulting in a double stranded break, and the primer binding site binds to the first strand of the target nucleic acid, which is the target strand and same strand to which the Type V CRISPR-Cas effector protein is recruited, thereby modifying the target nucleic acid.

2. The method of claim 1, wherein the primer binding site is length of about four nucleotide to about 100 nucleotides, optionally, wherein the primer binding site is at least 45 nucleotides in length, or about 45 nucleotides to about 100 nucleotides.

3. The method of claim 1, wherein the RT template is a length of about seven to about 100 nucleotides, optionally, wherein the RT template is a length of about 40 nucleotides or less.

4. The method of claim 1, wherein the extended portion of the extended guide RNA is linked to the Type V CRISPR nucleic acid and/or the tracrRNA via a linker, optionally wherein the linker is 1 to 100 nucleotides in length.

5. The method of claim 1, wherein when the extended portion is located 5' of the crRNA, the Type V CRISPR-Cas effector protein is modified to reduce or eliminate self-processing RNAse activity.

6. The method of claim 1, further comprising contacting the target nucleic acid with a Dna2 polypeptide and/or a 5' flap endonuclease (FEN), optionally wherein the FEN and/or Dna2 polypeptide is overexpressed (in the presence of the target nucleic acid), and/or optionally wherein the FEN is a fusion protein comprising an FEN domain fused to the Type V CRISPR-Cas effector protein and/or wherein the Dna2 polypeptide is a fusion protein comprising an Dna2 domain fused to the Type V CRISPR-Cas effector protein.

7. A method of modifying a target nucleic acid, the method comprising:
   contacting the target nucleic acid with
   (a) a Type V CRISPR-Cas effector protein;
   (b) a reverse transcriptase, and
   (c) an extended guide nucleic acid, wherein the extended guide nucleic acid comprises:
      (i) a Type V CRISPR nucleic acid; and
      (ii) an extended portion comprising a primer binding site and a reverse transcriptase template (RT template), wherein the extended portion of the extended guide nucleic acid comprises an RT template and a primer binding site, optionally wherein the extended portion is fused to either the 5' end or 3' end of the Type V CRISPR nucleic acid and/or the RT template of the extended portion is 5' of the primer binding site, wherein the target nucleic acid is double stranded comprising a first strand and a second strand, the Type V CRISPR-Cas effector protein is a double stranded nuclease that cuts the first strand and the second strand of the target nucleic acid resulting in a double stranded break, and the primer binding site binds to the first strand of the target nucleic acid, which is the target strand and same strand to which the Type V CRISPR-Cas effector protein is recruited, and wherein the Type V CRISPR-Cas effector protein is a Type V CRISPR-Cas effector fusion protein and/or the reverse transcriptase is a reverse transcriptase fusion protein, wherein the Type V CRISPR-Cas fusion protein, the reverse transcriptase fusion protein and/or the extended guide nucleic acid is fused to one or more components that recruit the reverse transcriptase to the Type V CRISPR-Cas effector protein, optionally the one or more components recruit via protein-protein interactions, protein-RNA interactions, and/or chemical interactions, thereby modifying the target nucleic acid.

8. The method of claim 7, wherein the Type V CRISPR-Cas effector protein is a Type V CRISPR-Cas effector fusion protein comprising a Type V CRISPR-Cas effector protein domain fused to a peptide tag and the reverse transcriptase is a reverse transcriptase fusion protein comprising a reverse transcriptase domain fused (linked) to an affinity polypeptide that binds to the peptide tag, optionally wherein the target nucleic acid is contacted with two or more reverse transcriptase fusion proteins, optionally wherein the peptide tag comprises a GCN4 peptide tag, a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope and/or the affinity polypeptide is an antibody, an affibody, an anticalin, a monobody and/or a DARPin, optionally wherein the antibody is an scFv antibody.

9. The method of claim 8, wherein the peptide tag comprises 2 or more copies of the peptide tag.

10. The method of claim 7, wherein the extended guide nucleic acid is linked to an RNA recruiting motif, and the reverse transcriptase is a reverse transcriptase fusion protein comprising a reverse transcriptase domain fused to an affinity polypeptide that binds to the RNA recruiting motif, optionally wherein the target nucleic acid is contacted with two or more reverse transcriptase fusion proteins, optionally wherein the extended guide RNA is linked to two or more RNA recruiting motifs, optionally wherein the RNA recruiting motif and corresponding affinity polypeptide are a telomerase Ku binding motif and the affinity polypeptide of Ku; a telomerase Sm7 binding motif and the affinity polypeptide of Sm7; an MS2 phage operator stem-loop and the affinity polypeptide MS2 Coat Protein (MCP), a PP7 phage operator stem-loop and the affinity polypeptide PP7 Coat Protein (PCP); an SfMu phage Com stem-loop and the affinity polypeptide Com RNA binding protein; a PUF binding site (PBS) and the affinity polypeptide Pumilio/fem-3 mRNA binding factor (PUF); and/or a synthetic RNA-aptamer and the corresponding aptamer ligand.

11. A method of modifying a target nucleic acid, the method comprising:
contacting the target nucleic acid with
(a) a Type V CRISPR-Cas effector protein;
(b) a reverse transcriptase;
(c) an extended guide nucleic acid, wherein the extended guide nucleic acid comprises:
(i) a Type V CRISPR nucleic acid; and
(ii) an extended portion comprising a primer binding site and a reverse transcriptase template (RT template); and
(d) a 5'-3' exonuclease,
wherein the extended portion of the extended guide nucleic acid comprises an RT template and a primer binding site, optionally wherein the extended portion is fused to either the 5' end or 3' end of the Type V CRISPR nucleic acid and/or the RT template of the extended portion is 5' of the primer binding site, and
wherein the target nucleic acid is double stranded comprising a first strand and a second strand, the Type V CRISPR-Cas effector protein is a double stranded nuclease that cuts the first strand and the second strand of the target nucleic acid resulting in a double stranded break, and the primer binding site binds to the first strand of the target nucleic acid, which is the target strand and same strand of the target nucleic acid to which the Type V CRISPR-Cas effector protein is recruited, thereby modifying the target nucleic acid.

12. The method of claim 11, wherein the 5'-3' exonuclease is fused to a Type V CRISPR-Cas effector protein, optionally to a Type V CRISPR-Cas fusion protein.

13. The method of claim 11, wherein (a) the 5'-3' exonuclease is a fusion protein comprising the 5'-3' exonuclease fused to a peptide tag and the Type V CRISPR-Cas effector protein is a fusion protein comprising a Type V CRISPR-Cas effector protein domain fused to an affinity polypeptide that is capable of binding to the peptide tag, (b) the 5'-3' exonuclease is a fusion protein comprising the 5'-3' exonuclease fused to an affinity polypeptide that is capable of binding to the peptide tag and the Type V CRISPR-Cas effector protein is a fusion protein comprising a Type V CRISPR-Cas effector protein domain fused to a peptide tag, or (c) the 5'-3' exonuclease is a fusion protein comprising the 5'-3' exonuclease fused to an affinity polypeptide that is capable of binding to an RNA recruiting motif and the extended guide nucleic acid is linked to an RNA recruiting motif.

14. The method of claim 11, wherein the 5'-3' exonuclease is a RecE exonuclease, a RecJ exonuclease, a T5 exonuclease or a T7 exonuclease.

15. The method of claim 11, further comprising contacting the target nucleic acid with a Dna2 polypeptide and/or a 5' flap endonuclease (FEN), optionally wherein the FEN and/or Dna2 polypeptide is overexpressed in the presence of the target nucleic acid, and/or optionally wherein the FEN is a fusion protein comprising an FEN domain fused to the Type V CRISPR-Cas effector protein and/or wherein the Dna2 polypeptide is a fusion protein comprising an Dna2 domain fused to the Type V CRISPR-Cas effector protein.

* * * * *

UNITED STATES PATENT AND TRADEMARK OFFICE
CERTIFICATE OF CORRECTION

PATENT NO. : 11,926,834 B2
APPLICATION NO. : 17/090334
DATED : March 12, 2024
INVENTOR(S) : Watts et al.

Page 1 of 1

It is certified that error appears in the above-identified patent and that said Letters Patent is hereby corrected as shown below:

In the Specification

Column 4, Line 29: Please insert a paragraph break between "(RBDs)" and "SEQ ID NO:53"

Column 5, Line 47: Please correct "1%" to read --±1%--

Column 14, Line 7: Please correct "0-conglycinin" to read --β-conglycinin--

Column 15, Lines 48-49: Please correct "Adh1-Sintrons" to read --Adh1-S introns--

Column 34, Line 49: Please insert a paragraph break between "the same" and "a "guide nucleic acid,""

Column 41, Line 36: Please correct "5-NGG-3'" to read --5'-NGG-3'--

Column 48, Line 14-15: Please correct "AAUUUCUACUAAGUGUAGAUGGAAUCCCUUCUGCAGCACCUGG" to read --AAUUUCUACUAAGUGUAGAUGGAAUCCCUUCUGCAGCACCUGG--

Column 48, Line 18-19: Please correct "TTTCGGAATCCCTTCTGCAGCACCTGG" to read --TTTCGGAATCCCTTCTGCAGCACCTGG--

Column 48, Line 23: Please correct "XLI-Blue" to read --XL1-Blue--

Column 49, Line 56: Please correct "BIOSCIENCE©" to read --BIOSCIENCE®--

Signed and Sealed this
Thirteenth Day of August, 2024

Katherine Kelly Vidal
*Director of the United States Patent and Trademark Office*